(12) United States Patent
Rabideau et al.

(10) Patent No.: US 10,526,629 B2
(45) Date of Patent: Jan. 7, 2020

(54) RNA POLYMERASE VARIANTS

(71) Applicant: ModernaTX, Inc., Cambridge, MA (US)

(72) Inventors: Amy E. Rabideau, Waltham, MA (US); Athanasios Dousis, Cambridge, MA (US); Kanchana Ravichandran, Cambridge, MA (US); Elissa Hobert, Cambridge, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

(21) Appl. No.: 16/432,541

(22) Filed: Jun. 5, 2019

(65) Prior Publication Data
US 2019/0309337 A1 Oct. 10, 2019

Related U.S. Application Data

(63) Continuation of application No. PCT/US2018/046989, filed on Aug. 17, 2018.

(60) Provisional application No. 62/677,527, filed on May 29, 2018, provisional application No. 62/638,684, filed on Mar. 5, 2018, provisional application No. 62/628,484, filed on Feb. 9, 2018, provisional application No. 62/547,677, filed on Aug. 18, 2017.

(51) Int. Cl.
*C12N 9/12* (2006.01)
*C12P 19/34* (2006.01)

(52) U.S. Cl.
CPC ............ *C12P 19/34* (2013.01); *C12N 9/1247* (2013.01); *C12Y 207/11023* (2013.01)

(58) Field of Classification Search
CPC .................................................. C12N 9/1241
See application file for complete search history.

(56) References Cited

U.S. PATENT DOCUMENTS

| | | | |
|---|---|---|---|
| 7,335,471 B2 | 2/2008 | Guillerez et al. |
| 8,710,200 B2 | 4/2014 | Schrum et al. |
| 8,754,062 B2 | 6/2014 | De Fougerolles et al. |
| 8,822,663 B2 | 9/2014 | Schrum et al. |
| 8,846,348 B2 | 9/2014 | Jendrisak et al. |
| 8,916,352 B2 | 12/2014 | Cheng |
| 8,999,380 B2 | 4/2015 | Bancel et al. |
| 9,005,930 B2 | 4/2015 | Jendrisak et al. |
| 9,045,740 B2 | 6/2015 | Martin et al. |
| 9,115,380 B2 | 8/2015 | Jendrisak et al. |
| 9,221,891 B2 | 12/2015 | Bancel et al. |
| 9,303,079 B2 | 4/2016 | Bancel et al. |
| 9,464,124 B2 | 10/2016 | Bancel et al. |
| 9,512,456 B2 | 12/2016 | Wang et al. |
| 9,597,380 B2 | 3/2017 | Chakraborty et al. |
| 9,868,691 B2 | 1/2018 | Benenato et al. |
| 9,872,900 B2 | 1/2018 | Ciaramella et al. |
| 10,034,951 B1 | 7/2018 | Roy et al. |
| 10,064,934 B2 | 9/2018 | Ciaramella et al. |
| 10,064,935 B2 | 9/2018 | Ciaramella et al. |
| 10,124,055 B2 | 11/2018 | Ciaramella et al. |
| 10,144,942 B2 | 12/2018 | Strack-Logue et al. |
| 10,207,010 B2 | 2/2019 | Besin et al. |
| 10,273,269 B2 | 4/2019 | Ciaramella |
| 2011/0143397 A1 | 6/2011 | Kariko et al. |
| 2013/0102034 A1 | 4/2013 | Schrum et al. |
| 2013/0224793 A1 | 8/2013 | Martin et al. |
| 2013/0245103 A1 | 9/2013 | de Fougerolles et al. |
| 2013/0259923 A1 | 10/2013 | Bancel et al. |
| 2013/0266640 A1 | 10/2013 | De Fougerolles et al. |
| 2014/0147432 A1 | 5/2014 | Bancel et al. |
| 2014/0148502 A1 | 5/2014 | Bancel et al. |
| 2014/0193482 A1 | 7/2014 | Bancel et al. |
| 2014/0206752 A1 | 7/2014 | Afeyan et al. |
| 2014/0378538 A1 | 12/2014 | Bancel |
| 2015/0141499 A1 | 5/2015 | Bancel et al. |
| 2015/0307542 A1 | 10/2015 | Roy et al. |
| 2015/0315541 A1 | 11/2015 | Bancel et al. |
| 2015/0368625 A1 | 12/2015 | Segall-Shapiro et al. |
| 2016/0024141 A1 | 1/2016 | Issa et al. |
| 2016/0032273 A1 | 2/2016 | Shahrokh et al. |
| 2016/0038612 A1 | 2/2016 | Hoge et al. |
| 2016/0317647 A1 | 11/2016 | Ciaramella et al. |
| 2017/0202979 A1 | 7/2017 | Chakraborty et al. |
| 2017/0130255 A1 | 10/2017 | Wang et al. |
| 2018/0000953 A1 | 1/2018 | Almarsson et al. |
| 2018/0002393 A1 | 1/2018 | Bancel et al. |
| 2018/0105551 A1 | 4/2018 | Chivukula et al. |
| 2018/0237817 A1 | 8/2018 | Roos et al. |
| 2018/0237849 A1 | 8/2018 | Thompson |

(Continued)

FOREIGN PATENT DOCUMENTS

| | | | |
|---|---|---|---|
| EP | 2042606 A1 | 4/2009 |
| EP | 2377938 A1 | 10/2011 |

(Continued)

OTHER PUBLICATIONS

Bandwar et al. The Transition to an Elongation Complex by T7 RNA Polymerase is a Multistep Process. J. Biol. Chem. Jun. 4, 2007; 282: 22879-22886.

Bandwar et al., Sequential release of promoter contacts during transcription initiation to elongation transition. J Mol Biol. Jul. 7, 2006;360(2):466-83. Epub May 26, 2006.

Brieba et al., Scanning mutagenesis reveals roles for helix n of the bacteriophage T7 RNA polymerase thumb subdomain in transcription complex stability, pausing, and termination. J Biol Chem. Mar. 30, 2001;276(13):10306-13. Epub Dec. 21, 2000.

(Continued)

*Primary Examiner* — Maryam Monshipouri
(74) *Attorney, Agent, or Firm* — Wolf, Greenfield & Sacks, P.C.

(57) ABSTRACT

The present disclosure provides, in some aspects, variant RNA polymerases, the use of which increases transcription efficiency while reducing the number of double-stranded RNA contaminates and run-on transcripts produced during an in vitro transcription reaction.

14 Claims, 49 Drawing Sheets

Specification includes a Sequence Listing.

(56) References Cited

U.S. PATENT DOCUMENTS

| | | |
|---|---|---|
| 2018/0243225 A1 | 8/2018 | Ciaramella |
| 2018/0243230 A1 | 8/2018 | Smith |
| 2018/0271970 A1 | 9/2018 | Ciaramella et al. |
| 2018/0273977 A1 | 9/2018 | Mousavi et al. |
| 2018/0274009 A1 | 9/2018 | Marquardt et al. |
| 2018/0280496 A1 | 10/2018 | Ciaramella et al. |
| 2018/0289792 A1 | 10/2018 | Ciaramella et al. |
| 2018/0303929 A1 | 10/2018 | Ciaramella et al. |
| 2018/0311336 A1 | 11/2018 | Ciaramella et al. |
| 2018/0318409 A1 | 11/2018 | Valiante et al. |
| 2018/0363019 A1 | 12/2018 | Hoge |
| 2019/0002850 A1 | 1/2019 | Miller et al. |
| 2019/0008938 A1 | 1/2019 | Ciaramella et al. |
| 2019/0099481 A1 | 4/2019 | Ciaramella et al. |
| 2019/0144490 A1 | 5/2019 | Hogrefe et al. |
| 2019/0192646 A1 | 6/2019 | Cohen et al. |

FOREIGN PATENT DOCUMENTS

| | | |
|---|---|---|
| JP | 2011-223982 A | 11/2011 |
| WO | WO 2011/128444 A2 | 10/2011 |
| WO | WO 2013/102203 A1 | 7/2013 |
| WO | WO 2014/152027 A1 | 9/2014 |
| WO | WO 2016/164762 A1 | 10/2016 |
| WO | WO 2016/201377 A1 | 12/2016 |
| WO | WO 2017/015457 A1 | 1/2017 |
| WO | WO 2017/020026 A1 | 2/2017 |
| WO | WO 2017/053297 A1 | 3/2017 |
| WO | WO 2017/062513 A1 | 4/2017 |
| WO | WO 2017/066789 A1 | 4/2017 |
| WO | WO 2017/070601 A1 | 4/2017 |
| WO | WO 2017/070624 A1 | 4/2017 |
| WO | WO 2017/123748 A1 | 7/2017 |
| WO | WO 2017/201340 A1 | 11/2017 |
| WO | WO 2017/201342 A1 | 11/2017 |
| WO | WO 2017/201347 A1 | 11/2017 |
| WO | WO 2018/053209 A1 | 3/2018 |
| WO | WO 2018/075980 A1 | 4/2018 |
| WO | WO 2018/081459 A1 | 5/2018 |
| WO | WO 2018/081788 A1 | 5/2018 |
| WO | WO 2018/089851 A1 | 5/2018 |
| WO | WO 2018/107088 A1 | 6/2018 |
| WO | WO 2018/111967 A1 | 6/2018 |
| WO | WO 2018/144082 A1 | 8/2018 |
| WO | WO 2018/144778 A1 | 8/2018 |
| WO | WO 2018/170245 A1 | 9/2018 |
| WO | WO 2018/170256 A1 | 9/2018 |
| WO | WO 2018/170260 A1 | 9/2018 |
| WO | WO 2018/170270 A1 | 9/2018 |
| WO | WO 2018/170347 A1 | 9/2018 |
| WO | WO 2018/175783 A1 | 9/2018 |
| WO | WO 2018/187590 A2 | 10/2018 |
| WO | WO 2018/200737 A1 | 11/2018 |
| WO | WO 2018/232355 A1 | 12/2018 |
| WO | WO 2018/232357 A1 | 12/2018 |
| WO | WO 2019/005539 A1 | 1/2019 |
| WO | WO 2019/036670 A1 | 2/2019 |
| WO | WO 2019/036682 A1 | 2/2019 |
| WO | WO 2019/036683 A1 | 2/2019 |
| WO | WO 2019/036685 A1 | 2/2019 |
| WO | WO 2019/103993 A1 | 5/2019 |
| WO | WO 2019/148101 A1 | 8/2019 |

OTHER PUBLICATIONS

Gaal et al., DNA-binding determinants of the alpha subunit of RNA polymerase: novel DNA-binding domain architecture. Genes Dev. Jan. 1, 1996;10(1):16-26.

Gardner et al. Initiation, elongation, and processivity of carboxyl-terminal mutants of T7 RNA polymerase. Biochemistry. Mar. 11, 1997;36(10):2908-18.

Grosjean, H., Modification and editing of RNA: historical overview and important facts to remember. Fine-tuning of RNA functions by modification and editing. Topics Curr Gen. Jan. 2005; 12: 1-22.

Ma et al. Probing conformational changes in T7 RNA polymerase during initiation and termination by using engineered disulfide linkages. Proc Natl Acad Sci U S A. Dec. 6, 2005;102(49):17612-7. Epub Nov. 21, 2005.

Tang et al. Relaxed rotational and scrunching changes in P266L mutant of T7 RNA polymerase reduce short abortive RNAs while delaying transition into elongation. PLoS One. Mar. 20, 2014;9(3):e91859. doi: 10.1371/journal.pone.0091859. eCollection 2014.

Vaccinia Cap1
- Inverted G: N7MeG
- Rear position: G with 2'OMe mGpppAG trinuc
- Inverted G: N7MeG
- Rear position: A with 2'OMe mGmpppAG trinuc
- Inverted G: N7MeG with 3'OMe
- Rear position: A with 2'OMe

RNA POLYMERASE VARIANTS

RELATED APPLICATIONS

This application is a continuation of international application number PCT/US2018/046989, filed Aug. 17, 2018, which was published under PCT Article 21(2) in English and claims the benefit under 35 U.S.C. § 119(e) of U.S. provisional application No. 62/547,677, filed Aug. 18, 2017, U.S. provisional application No. 62/628,484, filed Feb. 9, 2018, U.S. provisional application No. 62/638,684, filed Mar. 5, 2018, and U.S. provisional application No. 62/677,527, filed May 29, 2018, each of which is incorporated by reference herein in its entirety.

BACKGROUND

In vitro transcription (IVT) uses bacteriophage DNA-dependent ribonucleic acid (RNA) polymerases (e.g., SP6, T3 and T7) to synthesize template-directed mRNA transcripts. Problems in the IVT reaction can result in complete failure (e.g., no transcript generated) or in transcripts that are the incorrect size (e.g., shorter or longer than expected). Specific problems associated with IVT reactions include, for example, abortive (truncated) transcripts, run-on transcripts, polyA tail variants/3' heterogeneity, mutated transcripts, and/or double-stranded contaminants produced during the reactions.

RNA polymerases exhibit three phases of transcription—initiation, elongation and termination. During the initiation phase, the RNA polymerase binds to a specific promoter DNA sequence, opens the DNA duplex and feeds the template strand into the active site. T7 RNA polymerase, for example, forms a structure referred to as initiation complex, which includes a six-helix bundle sub-domain (the promoter binding domain) that interacts with the promoter to initiate DNA duplex melting. While bound to the promoter, the polymerase produces many short (truncated) transcripts from 2-12 nucleotides (nt) in length, a process often referred to as abortive synthesis/initiation. The truncated RNA transcripts cannot be converted to full-length transcripts by RNA polymerase and become by-products that accumulate during transcription. After the transition to the elongation phase and release of the promoter, the polymerase proceeds down the DNA template producing a full-length RNA transcript.

During the elongation phase, RNA polymerase often continues to transcribe DNA beyond the point at which termination should be initiated, generating longer than expected RNA transcripts ("run-on transcripts"). T7 RNA polymerase, for example, adds nucleotides to the end of a transcript before 'falling off' the template. Studies suggest that more than 70% of transcripts generated by T7 RNA polymerase in vitro may be run-on transcripts. In some cases, these aberrant RNA products are twice the length of the encoded sequence. Because run-on transcription is stochastic, there is often great 3' heterogeneity among products in a given IVT reaction. This 3' heterogeneity is problematic for downstream applications, such as ligation reactions, which are dependent on RNA transcripts of a defined length and/or nucleotide composition.

SUMMARY

During the initiation of transcription, RNA polymerase balances two opposing phases. The polymerase must first associate with the promoter tightly enough to permit dissociation of the two DNA strands (one of which is the template strand) and commence transcription. The polymerase must then release the promoter and enter a highly processive elongation phase. Competition between these two phases leads to the production of abortive transcripts. The polymerase repeatedly tries to clear the promoter but is unable to overcome the transition barrier and releases short (abortive) RNA products. Conversely, the polymerase often fails to 'run-off' the DNA template, generating a population of RNA transcripts with 3' heterogeneity. Provided herein are variant RNA polymerases, which increase transcription efficiency and 3' homogeneity, run-on transcripts, double-stranded contaminants, or any combination thereof, produced during an in vitro transcription (IVT) reaction, for example.

During the transition from initiation to elongation, RNA polymerase undergoes a conformational change requiring a large rearrangement of the amino-terminal domain (N-terminal domain) (see, e.g., Bandwar, R P et al. Journal of Biological Chemistry 282, 22879-22886 (2009); Guillerez, J. et al. Proc National Acad Sci 102, 5958-5963 (2005); Durniak, K. et al. Science (New York, N.Y.)322, 553 (2008); and Tahirov, T. H. et al. Nature 420, 43-50 (2002), each of which is incorporated herein by reference. Within this N-terminal domain is a "C-helix" (e.g., amino acids 28-71 of T7 RNA polymerase) and a "C-linker" (e.g., amino acids 258-266 of T7 RNA polymerase), each of which contains subregions (amino acids 42-47 and 257-262, respectively) that undergo a conformational change from a loop structure to a helix structure as the RNA polymerase transitions from an initiation complex to an elongation complex (see, e.g., FIG. 10), abolishing the promoter binding site, enlarging the active site and creating an exit tunnel for the RNA transcript. Mutations to subregions in the C-helix structure and/or the C-linker linker region may drive the conformation equilibrium toward the elongation complex by increasing the thermodynamic stability of the elongation complex relative to the initiation complex. Without being bound by theory, it is also thought that mutations in select regions, such as the C-helix structure and/or the C-linker linker region, can change how the exit tunnel of the polymerase interacts with the transcript during elongation, causing a significant reduction in transcription errors (e.g., run-on transcripts). Thus, the variant polymerases of the present disclosure include a (at least one) mutation in the C-helix and/or C-linker to drive the conformation equilibrium toward the elongation complex.

Other regions of the N-terminal domain that contain loop structures that transition to helix structures as the polymerase proceeds from initiation to elongation may be mutated (point mutation, referred to as a substitution), as provided herein. Non-limiting examples of such loop-to-helix regions include regions that span amino acids 55-73, 164-169, or 176-187 of T7 RNA polymerase (e.g., SEQ ID NO:1), or regions of other single subunit RNA polymerases (see, e.g., Cermakian, N. et al. J Mol Evol 45, 671-681 (1997), incorporated herein by reference) that are homologous (e.g., at least 80%, at least 90%, at least 95%, or at least 98% identical to) to the foregoing regions. Non-limiting examples of other single subunit RNA polymerases include T3 RNA polymerase, K11 RNA polymerase, and SP6 RNA polymerase.

In some embodiments, the RNA polymerase variants (e.g. T7 RNA polymerase variants, include mutations to residues that have a high-helix propensity (e.g., alanine) or that constrain the backbone flexibility to specifically match that of the elongation complex.

Further provided herein, are RNA polymerase variants that include at least one additional amino acid in the C terminus of the polymerase. For example, T7 RNA polymerase variants may include at least one additional amino acid, such as an additional glycine (G) in the C terminus of the polymerase. Surprisingly, the population of RNA transcripts produced using a T7 RNA polymerase modified to include an additional G in the C-terminal "foot" region (e.g., the region comprising "FAFA" (SEQ ID NO: 172) amino acids at positions 880-883 of wild-type T7 RNAP) exhibits less 3' heterogeneity. For example, as shown in FIG. 23, a T7 RNA polymerase variant that includes a C-terminal glycine (i.e., . . . FAFAG (SEQ ID NO: 329)) produces a RNA transcript population in which at least 85% of the transcripts are homogeneous at the 3' end. This data is particularly unexpected, given that previous studies have shown that C-terminal additions/insertions resulted in loss of function of T7 polymerase (Gardner L P, et al. *Biochemistry* 36, 2908-2918 (1997) and Gross L, et al. *Journal of Molecular Biology* 228, 488-505 (1992)).

Also provided herein are methods of capping a ssRNA (e.g., mRNA) with cap analogs (e.g., trinucleotides) co-transcriptionally (co-transcriptional capping methods) in an in vitro transcription assay using a T7 RNA polymerase variant described herein (e.g., T7 RNA polymerase variant G47A or G47A* C-terminal variant). Efficient co-transcriptional capping typically includes a double-stranded DNA (dsDNA) template that initiates transcription with 5'ATP and equimolar concentrations of NTPs and trinucleotides. Under these conditions, T7 RNA polymerase exhibits severely reduced initiation activity with 5'ATP. Unexpectedly, the data provided herein shows that, in the presence of GAG trinucleotides (e.g., $m^7GpppA_{2'OMe}pG$), for example, the limited initiation activity of T7 RNA polymerase with 5'ATP drives initiation with the trinucleotide rather than 5'ATP, generating capped RNA products co-transcriptionally. Surprisingly, in some embodiments, greater than 90% of the RNA produced comprises single-stranded full-length transcripts, at least 90% of the RNA produced includes a functional cap, and the RNA produced does not elicit a substantial cytokine response, even in the absence of post-IVT purification.

Thus, some aspects of the present disclosure provide RNA polymerase variants comprising at least one amino acid substitution, relative to wild-type polymerase, that causes at least one loop structure of the RNA polymerase variant to undergo a conformational change to a helix structure as the RNA polymerase variant transitions from an initiation complex to an elongation complex. In some embodiments, at least one amino acid substitution is estimated to have a more negative change in folding free energy in the elongation complex than in the initiation complex. In some embodiments, at least one amino acid substitution has a high-helix propensity, relative to wild-type amino acid. In some embodiments, the RNA polymerase variant comprises an (at least one) additional amino acid residue at the C terminus. For example, an RNA polymerase variant (e.g., a T7 RNA polymerase variant) may comprise a glycine (G) at the C terminus.

In some embodiments, the RNA polymerase is a T7 RNA polymerase. In some embodiments, the RNA polymerase is a T3 RNA polymerase. In some embodiments, the RNA polymerase is a SP6 RNA polymerase. In some embodiments, the RNA polymerase is a K11 RNA polymerase.

In some embodiments, at least one loop structure is in the C-helix structure. In some embodiments, at least one loop structure is in the C-linker structure. In some embodiments, at least one loop structure is present in a region within amino acids 55-73, 164-169, or 176-187 of T7 RNA polymerase, or a RNA polymerase homologous to T7 RNA polymerase.

In some embodiments, at least one amino acid substitution is at least one high-helix propensity amino acid substitution. For example, at least one high-helix propensity amino acid substitution may be selected from alanine, isoleucine, leucine, arginine, methionine, lysine, glutamine, and/or glutamate. In some embodiments, at least one high-helix propensity amino acid substitution is alanine. In some embodiments, at least one high-helix propensity amino acid substitution is isoleucine. In some embodiments, at least one high-helix propensity amino acid substitution is leucine. In some embodiments, at least one high-helix propensity amino acid substitution is arginine. In some embodiments, at least one high-helix propensity amino acid substitution is methionine. In some embodiments, at least one high-helix propensity amino acid substitution is lysine. In some embodiments, at least one high-helix propensity amino acid substitution is glutamine. In some embodiments, at least one high-helix propensity amino acid substitution is glutamate.

In some embodiment, a T7 RNA polymerase is modified to include at least one amino acid substitution of a high-helix propensity amino acid in at least one position selected from E42 (e.g., E42R), S43 (e.g., S43A), Y44 (e.g., Y44A), E45 (e.g., E45R/L), M46 (e.g., M46A), G47 (e.g., G47A), A255 (e.g., A255K/Q/Y/I), R257 (e.g., R257A), A258 (e.g., A258R/E/L), G259 (e.g., G259A), A260 (e.g., A260R/E/L), L261 (e.g., L261A) and A262 (e.g., A262R/E/L). The T7 RNA polymerase may further comprise, in some embodiments, one or more additional amino acid substitutions (in addition to at least one high-helix propensity amino acid substitution). Thus, the present disclosure encompasses the further modification of existing (e.g., currently-available and/or commercially-available) T7 RNA polymerase variants with one or more high-helix propensity amino acid substitutions as provided herein.

In some embodiments, a T7 RNA polymerase comprises an amino acid sequence of SEQ ID NO:1 modified to include at least one amino acid substitution of a high-helix propensity amino acid at a position selected from E42 (e.g., E42R), S43 (e.g., S43A), Y44 (e.g., Y44A), E45 (e.g., E45R/L), M46 (e.g., M46A) and G47 (e.g., G47A). In some embodiments, at least one amino acid substitution comprises S43A. In some embodiments, at least one amino acid substitution comprises G47A.

In some embodiments, a T7 RNA polymerase comprises an amino acid sequence of SEQ ID NO:99, SEQ ID NO:100, SEQ ID NO:294, SEQ ID NO:295, or SEQ ID NO:296 modified to include at least one amino acid substitution of a high-helix propensity amino acid at a position selected from E42 (e.g., E42R), S43 (e.g., S43A), Y44 (e.g., Y44A), E45 (e.g., E45R/L), M46 (e.g., M46A) and G47 (e.g., G47A). In some embodiments, at least one amino acid substitution comprises S43A. In some embodiments, at least one amino acid substitution comprises G47A.

In some embodiments, a T7 RNA polymerase comprises an amino acid sequence of SEQ ID NO:1 modified to include at least one amino acid substitution of a high-helix propensity amino acid at a position selected from A255 (e.g., A255K/Q/Y/I), R257 (e.g., R257A), A258 (e.g., A258R/E/L), G259 (e.g., G259A), A260 (e.g., A260R/E/L), L261 (e.g., L261A) and A262 (e.g., A262R/E/L). In some embodiments, at least one amino acid substitution comprises R257A. In some embodiments, at least one amino acid substitution comprises G259A.

In some embodiments, a T7 RNA polymerase comprises an amino acid sequence of SEQ ID NO:99, SEQ ID NO:100, SEQ ID NO:294, SEQ ID NO:295, or SEQ ID NO:296 modified to include at least one amino acid substitution of a high-helix propensity amino acid at a position selected from A255 (e.g., A255K/Q/Y/I), R257 (e.g., R257A), A258 (e.g., A258R/E/L), G259 (e.g., G259A), A260 (e.g., A260R/E/L), L261 (e.g., L261A) and A262 (e.g., A262R/E/L). In some embodiments, at least one amino acid substitution comprises R257A. In some embodiments, at least one amino acid substitution comprises G259A.

Also provided herein, in some aspects, are T7 RNA polymerases comprising an amino acid sequence of SEQ ID NO:1 modified to include an amino acid substitution of a high-helix propensity amino acid (e.g., alanine, isoleucine, leucine, arginine, methionine, lysine, glutamine, and/or glutamate) at position G47, S43, R257, or G259. Further provided herein, in some aspects, are T7 RNA polymerases comprising an amino acid sequence of SEQ ID NO:99, SEQ ID NO:100, SEQ ID NO:294, SEQ ID NO:295, or SEQ ID NO:296 modified to include an amino acid substitution of a high-helix propensity amino acid (e.g., alanine, isoleucine, leucine, arginine, methionine, lysine, glutamine, and/or glutamate) at position G47, S43, R257, or G259.

In some embodiments, T7 RNA polymerases of the present disclosure comprise an amino acid sequence of SEQ ID NO:2, SEQ ID NO:3, SEQ ID NO:4 or SEQ ID NO:5. In some embodiments, T7 RNA polymerases of the present disclosure comprise an amino acid sequence of SEQ ID NO:107 or 108, SEQ ID NO:109 or 110, SEQ ID NO:111 or 112, or SEQ ID NO:113 or 114.

In some embodiments, a T7 RNA polymerase comprises at least one additional C-terminal amino acid. In some embodiments, a T7 RNA polymerase comprises at least two additional C-terminal amino acids.

In some embodiments, the at least two additional C-terminal amino acids comprise the same type of amino acid (e.g., all Gly, all Ala). In some embodiments, the at least two additional C-terminal amino acids comprise at least two different types of amino acids (e.g., GlyAla, AlaGly).

In some embodiments, a T7 RNA polymerase comprises at least three additional C-terminal amino acids. In some embodiments, the at least three additional C-terminal amino acids comprise at least two or at least three of the same type or different types of amino acids (e.g., GlyGlyGly, AlaAlaAla).

In some embodiments, a T7 RNA polymerase comprises 1 to 10 (e.g., 1, 2, 3, 4, 5, 6, 7, 8, 9, or 10) additional C-terminal amino acids. In some embodiments, a T7 RNA polymerase comprises 1 to 5 additional C-terminal amino acids.

In some embodiments, a T7 RNA polymerase comprises a C terminus that comprises a FAFAX$_n$ (SEQ ID NO: 171) motif, wherein X is any amino acid and n is any integer greater than zero. In some embodiments, X is glycine (G). In some embodiments, n is 1, 2, 3, 4, or 5. It should be understood that in embodiments, where n is greater than 1, such that the C terminal motif is FAFXX, FAFAXXX (SEQ ID NO: 319), FAFAXXXX (SEQ ID NO: 320), or FAFAXXXXX (SEQ ID NO: 321), for example, the X's may be the same amino acid or they may be different amino acids. For example, the C-terminal motif may be FAFAGG (SEQ ID NO: 322) or FAFAGGG (SEQ ID NO: 323), or the C-terminal motif may be FAFAGA (SEQ ID NO: 324), FAFAGC (SEQ ID NO: 325), FAFAGAA (SEQ ID NO: 326), FAFAGAG (SEQ ID NO: 327), FAFAGAC (SEQ ID NO: 328), etc. Other C-terminal amino acid combinations may be used.

In some embodiments, a T7 RNA polymerase comprises a C terminus that comprises a FAFAG (SEQ ID NO: 329) motif.

In some embodiments, a T7 RNA polymerase comprises a XAFAX$_n$ motif, a FXFAX$_n$ motif, FAXAX$_n$ motif, or a FAFXX$_n$ motif, wherein each X is any amino acid and n is any integer greater than zero. Thus, the present disclosure comprises various C-terminal F$^{880}$A$^{881}$F$^{882}$A$^{883}$ (SEQ ID NO: 172) motifs, wherein the amino acid at one or more of positions 880, 881, 882, or 883 (e.g., relative to wild-type T7 RNAP, e.g., SEQ ID NO:1) is modified to include at least one amino acid substitution, with or without an additional C-terminal amino acid (X$_n$).

In some aspects, the present disclosure provides RNA polymerases comprising at least one additional C-terminal amino acid relative to a corresponding wild-type RNA polymerase. In some embodiments, the RNA polymerase is selected from T7 RNA polymerases, T3 RNA polymerases, and SP6 RNA polymerases.

In some embodiments, the RNA polymerase further comprises at least one additional amino acid substitution. In some embodiments, the RNA polymerase further comprises an amino acid substitution corresponding to an amino acid substitution of SEQ ID NO:1 selected from G47A, S43A, R257A, and G259A.

In some embodiments, the RNA polymerase is a T7 RNA polymerase comprising an amino acid sequence at least 90%, at least 95%, at least 98%, or at least 99% identical to SEQ ID NO:1 modified to include an amino acid substitution at position 43±1 (e.g., 42, 43, or 44), 47±1 (e.g., 46, 47, or 48), 257±1 (e.g., 256, 257, or 258), and/or 259±1 (e.g., 258, 259, or 260), optionally wherein the amino acid substitution is alanine (A). In some embodiments, the RNA polymerase is a T3 RNA polymerase comprising an amino acid sequence at least 90%, at least 95%, or at least 98% identical to SEQ ID NO:6 modified to include an amino acid substitution at a position corresponding to wild-type T7 RNA polymerase position 43±1, 47±1, 257±1, and/or 259±1 (based on a sequence or structural alignment), optionally wherein the amino acid substitution is alanine (A). In some embodiments, the RNA polymerase is a SP6 RNA polymerase comprising an amino acid sequence at least 90%, at least 95%, at least 98%, or at least 99% identical to SEQ ID NO:7 modified to include an amino acid substitution at a position corresponding to wild-type T7 RNA polymerase position 43±1, 47±1, 257±1, and/or 259±1 (based on a sequence or structural alignment), optionally wherein the amino acid substitution is alanine (A).

Some aspects of the present disclosure provide T7 RNA polymerases comprising an amino acid sequence at least 90%, at least 95%, at least 98%, or at least 99% identical to SEQ ID NO:1 modified to include an amino acid substitution at position 43, 47, 257, and/or 259, optionally wherein the amino acid substitution is alanine (A).

Other aspects of the present disclosure provide T3 RNA polymerases comprising an amino acid sequence at least 90%, at least 95%, or at least 98% identical to SEQ ID NO:6 modified to include an amino acid substitution at a position corresponding to wild-type T7 RNA polymerase position 43, 47, 257, and/or 259, optionally wherein the amino acid substitution is alanine (A). Thus, in some embodiments, T3 RNA polymerases comprise an amino acid sequence at least 90%, at least 95%, or at least 98% identical to SEQ ID NO:6 modified to include an amino acid substitution at position 44, 48, 258, and/or 260, optionally wherein the amino acid substitution is alanine (A).

Yet other aspects of the present disclosure provide SP6 RNA polymerases comprising an amino acid sequence at least 90%, at least 95%, or at least 98% % identical to SEQ ID NO:7 modified to include an amino acid substitution at a position corresponding to wild-type T7 RNA polymerase position 43, 47, 257, and/or 259, optionally wherein the amino acid substitution is alanine (A). Thus, in some embodiments, SP6 TNA polymerases comprise an amino acid sequence at least 90%, at least 95%, or at least 98% % identical to SEQ ID NO:7 modified to include an amino acid substitution at position 15, 19, 230, and/or 232, optionally wherein the amino acid substitution is alanine (A).

The present disclosure also provides methods of producing RNA comprising contacting a DNA template with a RNA polymerase variant as described herein under conditions that result in the production of RNA transcript (e.g., under IVT condition).

The present disclosure further provides methods of performing an IVT reaction, comprising contacting a DNA template with a RNA polymerase variant as provided herein in the presence of nucleoside triphosphates (NTPs) and buffer under conditions that result in the production of RNA transcripts.

In some embodiments, the RNA transcript produced, when delivered to cells, optionally in unpurified form, stimulates cytokine response that is at least 50% (e.g., at least 60%, at least 70%, at least 80%, at least 95% or at least 98%) lower relative to RNA produced using wild-type RNA polymerase under the same IVT conditions.

In some embodiments, the concentration of dsRNA transcript produced by IVT is at least 50% (e.g., at least 60%, at least 70%, at least 80%, at least 95% or at least 98%) lower relative to dsRNA transcript produced using wild-type polymerase.

In some embodiments, less than 20% (e.g., less than 15%, less than 10%, less than 5%) of the RNA transcripts produced exhibit 3' heterogeneity.

In some embodiments, less than 50% (e.g., less than 40%, less than 30%, less than 20%, less than 10%) of the RNA transcript produced is truncated RNA transcript.

In some embodiments, less than 50% (e.g., less than 40%, less than 30%, less than 20%, less than 10%) of the RNA transcript produced is run-on RNA transcript.

In some embodiments, the amount of full-length RNA transcript produced is at least 15 times greater than the amount of the DNA template In some embodiments, the ratio of truncated RNA transcript:full-length RNA transcript produced is less than 1:1.

In some embodiments, the RNA transcript produced has less than 1 mutation per 100 nucleotides relative to the DNA template.

The present disclosure, in some aspects provides nucleic acids encoding the RNA polymerase variants and, in some embodiments, vectors (e.g., plasmids) and/or host cells (e.g., mammalian cells, e.g., human cells) comprising the nucleic acids.

The RNA transcripts produced by the methods of the present disclosure are also provided. In some embodiments, the RNA transcripts (e.g., mRNA) are formulated in a lipid nanoparticle. The lipid nanoparticle may comprise, for example, a molar ratio of 20-60% ionizable amino lipid, 5-25% non-cationic lipid, 25-55% sterol, and 0.5-15% PEG-modified lipid. See, e.g., WO 2017/070624, published 27 Apr. 2017, incorporated herein by reference.

Other compositions and kits comprising the RNA polymerase variants are encompassed herein.

Also provided herein are co-transcriptional capping methods for ribonucleic acid (RNA) synthesis, the methods comprising reacting a polynucleotide template with a T7 RNA polymerase variant, nucleoside triphosphates, and a cap analog under in vitro transcription reaction conditions to produce RNA transcript.

In some embodiments, greater than 80%, greater than 85%, or greater than 90% of the RNA transcript produced includes a functional cap. In some embodiments, greater than 95% of the RNA transcript produced includes a functional cap.

In some embodiments, the nucleoside triphosphates comprise unmodified or modified ATP, modified or unmodified UTP, modified or unmodified GTP, and/or modified or unmodified CTP.

In some embodiments, the T7 polymerase variant comprises an amino acid sequence of SEQ ID NO:1 (or an amino acid sequence that shares 90%-99%, e.g., at least 90%, at least 95%, at least 96%, at least 97%, at least 98%, or at least 99% identity with SEQ ID NO:1) modified to include at least one amino acid substitution of a high-propensity amino acid at a position selected from E42, S43, Y44, E45, M46, G47, A255, R257, and G259. In some embodiments, the T7 polymerase variant comprises an amino acid sequence of SEQ ID NO:1 (or an amino acid sequence that shares 90%-99%, e.g., at least 90%, at least 95%, at least 96%, at least 97%, at least 98%, or at least 99% identity with SEQ ID NO:1) modified to include amino acid substitution of G47A. In some embodiments, the T7 polymerase variant comprises an amino acid sequence of SEQ ID NO:1 (or an amino acid sequence that shares 90%-99%, e.g., at least 90%, at least 95%, at least 96%, at least 97%, at least 98%, or at least 99% identity with SEQ ID NO:1) modified to include amino acid substitution of S43A.

In some embodiments, the T7 polymerase variant comprises an amino acid sequence of SEQ ID NO:99 (or an amino acid sequence that shares 90%-99%, e.g., at least 90%, at least 95%, at least 96%, at least 97%, at least 98%, or at least 99% identity with SEQ ID NO:99) modified to include at least one amino acid substitution of a high-propensity amino acid at a position selected from E42, S43, Y44, E45, M46, G47, A255, R257, and G259. In some embodiments, the T7 polymerase variant comprises an amino acid sequence of SEQ ID NO:99 (or an amino acid sequence that shares 90%-99%, e.g., at least 90%, at least 95%, at least 96%, at least 97%, at least 98%, or at least 99% identity with SEQ ID NO:99) modified to include amino acid substitution of G47A. In some embodiments, the T7 polymerase variant comprises an amino acid sequence of SEQ ID NO:99 (or an amino acid sequence that shares 90%-99%, e.g., at least 90%, at least 95%, at least 96%, at least 97%, at least 98%, or at least 99% identity with SEQ ID NO:99) modified to include amino acid substitution of S43A.

In some embodiments, the T7 polymerase variant comprises an amino acid sequence of SEQ ID NO:100 (or an amino acid sequence that shares 90%-99%, e.g., at least 90%, at least 95%, at least 96%, at least 97%, at least 98%, or at least 99% identity with SEQ ID NO:100) modified to include at least one amino acid substitution of a high-propensity amino acid at a position selected from E42, S43, Y44, E45, M46, G47, A255, R257, and G259. In some embodiments, the T7 polymerase variant comprises an amino acid sequence of SEQ ID NO:100 (or an amino acid sequence that shares 90%-99%, e.g., at least 90%, at least 95%, at least 96%, at least 97%, at least 98%, or at least 99% identity with SEQ ID NO:100) modified to include amino acid substitution of G47A. In some embodiments, the T7 polymerase variant comprises an amino acid sequence of SEQ ID NO:100 (or an amino acid sequence that shares 90%-99%, e.g., at least 90%, at least 95%, at least 96%, at least 97%, at least 98%, or at least 99% identity with SEQ ID NO:100) modified to include amino acid substitution of S43A.

In some embodiments, the nucleoside triphosphates and cap analog are present in the reaction at equimolar concentrations. In some embodiments, a molar ratio of cap analog to nucleoside triphosphates in the reaction is greater than 1:1. In some embodiments, a molar ratio of cap analog to nucleoside triphosphates in the reaction is less than 1:1.

In some embodiments, the cap analog is a dinucleotide cap, a trinucleotide cap, or a tetranucleotide cap. In some embodiments, the cap analog is a trinucleotide cap.

In some embodiments, the trinucleotide cap comprises a sequence selected from the following sequences: GAA, GAC, GAG, GAU, GCA, GCC, GCG, GCU, GGA, GGC, GGG, GGU, GUA, GUC, GUG, and GUU.

In some embodiments, the trinucleotide cap comprises a sequence selected from the following sequences: $m^7GpppApA$, $m^7GpppApC$, $m^7GpppApG$, $m^7GpppApU$, $m^7GpppCpA$, $m^7GpppCpC$, $m^7GpppCpG$, $m^7GpppCpU$, $m^7GpppGpA$, $m^7GpppGpC$, $m^7GpppGpG$, $m^7GpppGpU$, $m^7GpppUpA$, $m^7GpppUpC$, $m^7GpppUpG$, and $m^7GpppUpU$.

In some embodiments, the trinucleotide cap comprises a sequence selected from the following sequences: $m^7G_{3'OMe}pppApA$, $m^7G_{3'OMe}pppApC$, $m^7G_{3'OMe}pppApG$, $m^7G_{3'OMe}pppApU$, $m^7G_{3'OMe}pppCpA$, $m^7G_{3'OMe}pppCpC$, $m^7G_{3'OMe}pppCpG$, $m^7G_{3'OMe}pppCpU$, $m^7G_{3'OMe}pppGpA$, $m^7G_{3'OMe}pppGpC$, $m^7G_{3'OMe}pppGpG$, $m^7G_{3'OMe}pppGpU$, $m^7G_{3'OMe}pppUpA$, $m^7G_{3'OMe}pppUpC$, $m^7G_{3'OMe}pppUpG$, and $m^7G_{3'OMe}pppUpU$.

In some embodiments, the trinucleotide cap comprises a sequence selected from the following sequences: $m^7G_{3'OMe}pppA_{2'OMe}pA$, $m^7G_{3'OMe}pppA_{2'OMe}pC$, $m^7G_{3'OMe}pppA_{2'OMe}pG$, $m^7G_{3'OMe}pppA_{2'OMe}pU$, $m^7G_{3'OMe}pppC_{2'OMe}pA$, $m^7G_{3'OMe}pppC_{2'OMe}pC$, $m^7G_{3'OMe}pppC_{2'OMe}pG$, $m^7G_{3'OMe}pppC_{2'OMe}pU$, $m^7G_{3'OMe}pppG_{2'OMe}pA$, $m^7G_{3'OMe}pppG_{2'OMe}pC$, $m^7G_{3'OMe}pppG_{2'OMe}pG$, $m^7G_{3'OMe}pppG_{2'OMe}pU$, $m^7G_{3'OMe}pppU_{2'OMe}pA$, $m^7G_{3'OMe}pppU_{2'OMe}pC$, $m^7G_{3'OMe}pppU_{2'OMe}pG$, and $m^7G_{3'OMe}pppU_{2'OMe}pU$.

In some embodiments, the trinucleotide cap comprises a sequence selected from the following sequences: $m^7GpppA_{2'OMe}pA$, $m^7GpppA_{2'OMe}pC$, $m^7GpppA_{2'OMe}pG$, $m^7GpppA_{2'OMe}pU$, $m^7GpppC_{2'OMe}pA$, $m^7GpppC_{2'OMe}pC$, $m^7GpppC_{2'OMe}pG$, $m^7GpppC_{2'OMe}pU$, $m^7GpppG_{2'OMe}pA$, $m^7GpppG_{2'OMe}pC$, $m^7GpppG_{2'OMe}pG$, $m^7GpppG_{2'OMe}pU$, $m^7GpppU_{2'OMe}pA$, $m^7GpppU_{2'OMe}pC$, $m^7GpppU_{2'OMe}pG$, and $m^7GpppU_{2'OMe}pU$.

In some embodiments, the trinucleotide cap comprises a sequence selected from the following sequences: GAG, GCG, GUG, and GGG. In some embodiments, the trinucleotide cap comprises sequence GAG. In some embodiments, the trinucleotide cap comprises $m^7GpppA_{2'Ome}pG$.

In some embodiments, the polynucleotide template includes a 2'-deoxythymidine residue at template position +1. In some embodiments, the polynucleotide template includes a 2'-deoxycytidine residue at template position +1. In some embodiments, the polynucleotide template includes a 2'-deoxyadenosine residue at template position +1. In some embodiments, the polynucleotide template includes a 2'-deoxyguanosine residue at template position +1.

Also provided herein are co-transcriptional capping methods for RNA synthesis, the methods comprising reacting a polynucleotide template with (a) a T7 RNA polymerase variant comprising at least one amino acid substitution, relative to wild-type RNA polymerase, that causes at least one loop structure of the RNA polymerase variant to undergo a conformational change to a helix structure as the RNA polymerase variant transitions from an initiation complex to an elongation complex, (b) nucleoside triphosphates, and (c) a trinucleotide cap comprising sequence $GpppA_{2'Ome}pG$, under in vitro transcription reaction conditions to produce RNA transcript, wherein the polynucleotide template includes a 2'-deoxythymidine residue at template position +1.

In some embodiments, the RNA transcript produced, when delivered to cells, optionally in unpurified form, does not stimulate a detectable cytokine response.

Further provided herein are compositions comprising an in vitro-transcribed (IVT) RNA and a pharmaceutically acceptable excipient, wherein the composition is substantially free of cytokine-inducing RNA contaminant in the absence of post-IVT purification.

A composition, in some embodiments, comprises an IVT RNA and a pharmaceutically acceptable excipient, wherein the composition has less than 5% uncapped RNA species.

In some embodiments, greater than 80%, 85%, or 90% of the IVT RNA include a functional cap. In some embodiments, greater than 95% of the IVT RNA include a functional cap.

In some embodiments, the IVT RNA is not chemically modified. In other embodiments, the IVT RNA is chemically modified.

In some embodiments, greater than 95% of the IVT RNA comprises single-stranded full-length transcripts.

In some embodiments, the RNA is produced by a process comprising: reacting a polynucleotide template with (a) a T7 RNA polymerase variant comprising at least one amino acid substitution, relative to wild-type RNA polymerase, that causes at least one loop structure of the RNA polymerase variant to undergo a conformational change to a helix structure as the RNA polymerase variant transitions from an initiation complex to an elongation complex, (b) nucleoside triphosphates, and (c) a trinucleotide cap comprising sequence $GpppA_{2'Ome}pG$, under in vitro transcription reaction conditions to produce RNA transcript, wherein the polynucleotide template includes a 2'-deoxythymidine residue at template position +1.

In some aspects, the disclosure provides T7 RNAP variants comprising an amino acid sequence of SEQ ID NOs: 294-313, wherein x is any amino acid and n is any integer, e.g., between 1 and 5 (e.g., 1, 2, 3, 4, or 5).

In some aspects, the disclosure provides a method of performing an IVT reaction, comprising contacting a DNA template with an RNA polymerase variant of the disclosure in the presence of nucleoside triphosphate and buffer under conditions that result in the production of RNA transcripts. In some embodiments, the RNA produced, when delivered to cells, optionally in unpurified form, stimulates a cytokine response that is at least 50% lower relative to the dsRNA transcript produced using a WT. In some embodiments, less than 30% of the RNA transcripts produced by the IVT reaction exhibit 3' heterogeneity.

BRIEF DESCRIPTION OF THE DRAWINGS

FIG. 2, right panel, shows a graph depicting hEPO expression in transfected cells.

FIG. 3, right graph, shows a depiction of IFNβ response in cells transfected with chemically-modified hEPO RNA transcripts (5-methoxy-uridine ($mo^5U$) modifications) produced using WT T7 RNA polymerase or one of the T7 RNA polymerase variants, S43A* (with C-terminal G) or G47A* (with C-terminal G), with or without reverse phase (RP) purification.

FIG. 6, right graph, shows the IP10 response in monocyte-derived macrophages transfected with chemically-modified (5-methoxy-uridine ($mo^5U$)) hEPO RNA transcript produced using WT T7 RNA polymerase or T7 RNA polymerase variants, S43A* (with C-terminal G) or G47A* (with C-terminal G).

FIG. 9A shows results from a LCMS analysis. FIG. 9B shows quantification of the 3' end population distribution from FIG. 9A.

FIG. 10 was generated from PDB crystal structures 1MSW and 1QLN and rendered in Molecular Operating Environment [Chemical Computing Group ULC].

FIG. 14A shows examples of dinucleotide- (Vaccinia cap1) or trinucleotide- (GAG or GmAG) caps. Trinucleotide caps were used in the co-transcriptional capping assay. FIG. 14B shows the mRNA yields of the co-transcriptional capping assay.

FIG. 14C shows that the mRNAs produced in the co-transcriptional capping assay were of high integrity. FIG. 14D shows the capped mRNAs produced by WT T7 RNA polymerase induced cytokine production in BJ fibroblasts, while the capped mRNAs produced by T7 RNA polymerase variant G47A* (with C-terminal G), surprisingly, did not induce cytokine production. FIG. 14E shows the capped mRNAs produced by WT T7 RNA polymerase did not express the encoded protein (hEPO) in BJ fibroblasts, while the capped mRNAs produced by T7 RNA polymerase variant G47A* (with C-terminal G) lead to hEPO expression level comparable to the control. The control is a mRNA produced by WT T7 RNA polymerase and capped with Vaccinia cap1.

FIG. 18A shows the analysis of intact mRNAs. FIG. 18B shows the analysis of the 5' ends of the mRNAs cleaved by RNase H.

FIG. 19A shows that the mRNAs have the same sequence, as analyzed by RNase T1 fingerprinting assay. FIG. 19B shows that the mRNAs have high degree of integrity. FIG. 19C shows that the mRNAs did not induce cytokine response in BJ fibroblasts.

FIG. 20C shows that the mRNA products are of high integrity. FIG. 20D shows the cytokine response of the mRNA products. FIG. 20E shows the expression of mRNA encoding hEPO in BJ fibroblasts. FIG. 20F shows the expression of mRNA encoding luciferase (Luc) in BJ fibroblasts. FIG. 20G shows the expression of mRNA encoding eGFP in BJ fibroblasts.

FIG. 24A shows results from a LCMS analysis of hEPO mRNA produced from IVT reactions using WT T7 RNAP with equimolar concentrations of NTPs (WT EQ), WT T7 RNAP with excess of GTP and ATP (WT alpha), or G47A* T7 RNAP with an additional C-terminal glycine with equimolar concentrations of NTPs (G47A* EQ). FIG. 24B shows quantification of the 3' end population distribution from FIG. 24A. FIG. 24C shows the percentage of clean 3' end populations produced in IVT reactions using unmodified mRNA. FIG. 24D shows the percentage of clean 3' end populations produced in IVT reactions using 1-methyl-pseudouridine-modified mRNA.

In FIG. 26A, either unmodified or 1-methyl-pseudouridine-modified mRNA is radiolabeled with $^{32}$P-CTP. In FIG. 26B, the reverse complement mRNA is radiolabeled with $^{32}$P-CTP.

DETAILED DESCRIPTION

Figure 1:
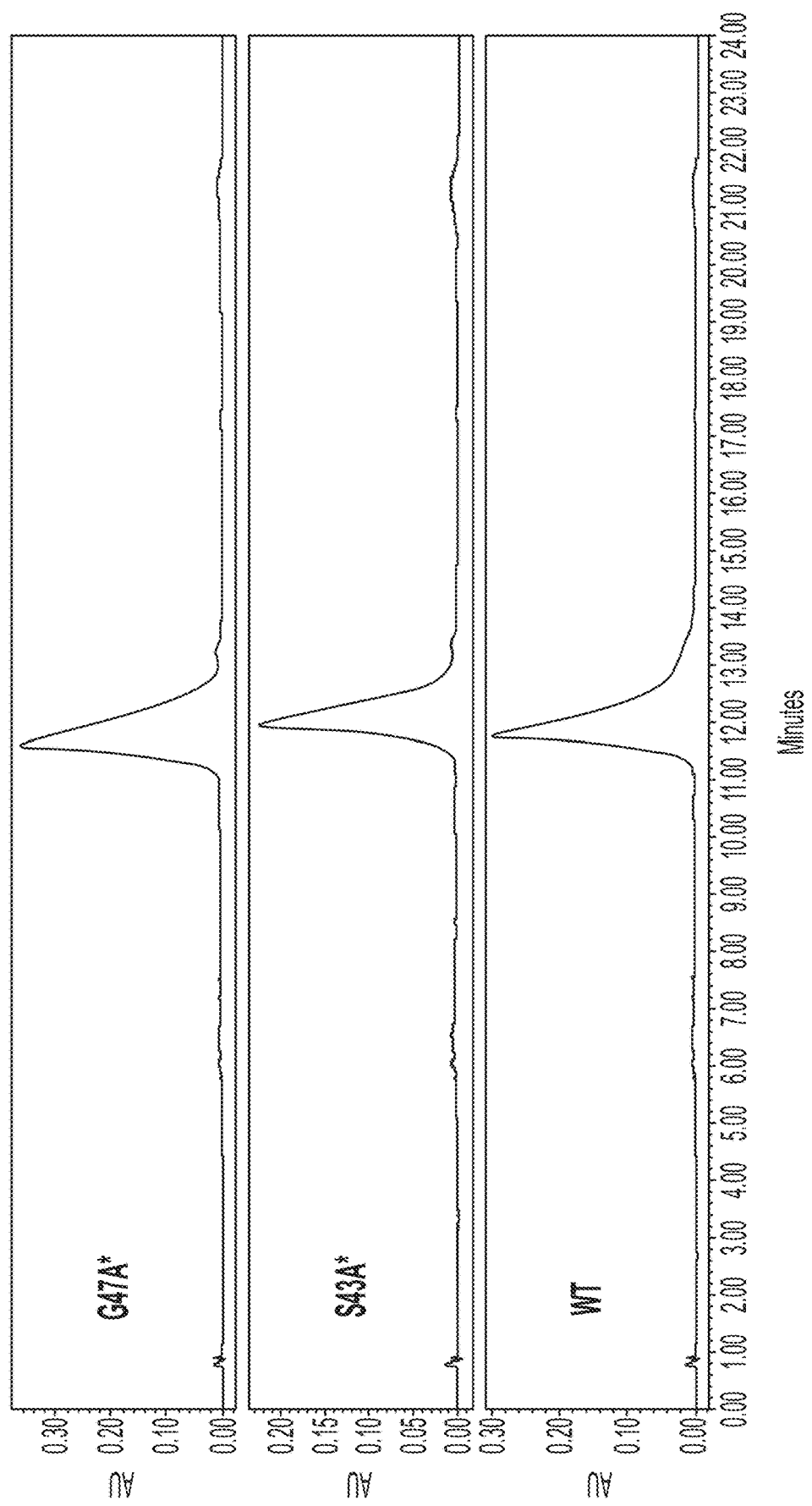
FIG. 1 shows HPLC chromatograms at 260 nm of human erythropoietin (hEPO) mRNA generated using wild-type (WT) T7 polymerase or T7 polymerase variants, G47A* (with C-terminal G) and S43A* (with C-terminal G).

The present disclosure provides RNA polymerase (RNAP) variants that increase transcription efficiency and 3' homogeneity while reducing the number of run-on transcripts, and/or double-stranded contaminants produced during an in vitro transcription (IVT) reaction, for example. These RNAP variants, which include, in some embodiments, a single amino acid substitution, facilitate the RNAP conformational transition from initiation complex to elongation complex, thereby reducing many of the problems associated with the transcription initiation phase.

Provided herein are unexpected experimental results demonstrating that modification(s) of the N-terminal C-helix and/or C-linker structure(s) of DNA-dependent RNA polymerase (e.g., T7 RNA polymerase) drives the conformation equilibrium of the polymerase toward the elongation complex, facilitating release of the DNA template promoter and commencement of a highly processive elongation phase. Surprisingly, use of the polymerase variants provided herein in IVT reactions reduces 3' heterogeneity among the transcripts produced, and also reduces (or eliminates) the production of double-stranded contaminants. Further, results show that the purity and expression levels of transcripts produced using the polymerase variants are comparable to those of transcripts produced using wild-type polymerase.

Thus, use of the RNA polymerase variants of the present disclosure reduces many of the problems associated with IVT reaction products. Although wild-type T7 RNA polymerase (RNAP) is used commonly in both industry and academia, several of its activities significantly compromise the purity of resulting RNA transcripts. In particular, use of this wild-type T7 RNAP enzyme results in the non-templated addition of nucleotides to the 3'-end of RNA transcripts. For example, wild-type T7 RNAP installs at least 1, and often 2 or more, non-templated nucleotides at the 3'-end with seemingly little preference for nucleobase identity. Surprisingly, the T7 RNAP variants as provided herein reduce the occurrence of 3' heterogeneity. In some embodiments, less than 30% of the RNA transcripts produced by IVT using a RNA polymerase variant of the present disclosure exhibit 3' heterogeneity. In some embodiments, less than 20% (e.g., less than 15%, 10%, or 5%) of the RNA transcripts produced by IVT using a RNA polymerase variant of the present disclosure exhibit 3' heterogeneity. In some embodiments, 1-20%, 1-15%, 1-10%, or 1-5% of the RNA transcripts produced by IVT exhibit 3' heterogeneity. In some embodiments, less than 1% of the RNA transcripts produced by IVT using a RNA polymerase variant of the present disclosure exhibit 3' heterogeneity.

Thus, use of the RNA polymerase variants of the present disclosure, for example, in an IVT reaction, results in the production of 'cleaner' RNA transcript (a population of RNA transcripts with reduced heterogeneity/increased homogeneity at the 3' end). In some embodiments, at least 70% of the RNA transcripts produced using the RNA polymerase variants of the present disclosure exhibit 3' homogeneity. In some embodiments, at least 75%, at least 80%, at least 85%, at least 90%, or at least 95% of the RNA transcripts produced using the RNA polymerase variants of the present disclosure exhibit 3' homogeneity. In some embodiments, at least 90% of the RNA transcripts produced using the RNA polymerase variants of the present disclosure exhibit 3' homogeneity. In some embodiments, at least 90%, at least 91%, at least 92%, at least 93%, at least 94%, at least 95%, at least 96% at least 97%, at least 98%, or at least 99% of the RNA transcripts produced using the RNA polymerase variants of the present disclosure exhibit 3' homogeneity.

Also, surprising herein were results demonstrating that the RNA transcripts produced using the amino acid substitution (e.g., S43A and/or G47A of SEQ ID NO:1) or C-terminal additions (e.g., WT, S43A*, and/or G47A* with one or more amino acid additions) T7 RNA polymerase variants, when delivered to cells, optionally in unpurified form (e.g., not purified by reverse phase chromatography), stimulates a cytokine response that is lower relative to RNA produced using wild-type RNA polymerase. In some embodiments, there is no detectable cytokine response from cells that have received an RNA transcript produced using a T7 RNA variant polymerase of the present disclosure. In some embodiments, RNA produced using a RNA polymerase variant (e.g., T7 RNAP S43A* variant and/or T7 RNAP G47A* variant) stimulates a cytokine response that is at least 50% (e.g., 55%, 60%, 65%, 70%, 75%, 80%, 85%, 90%, 95% or 100%) lower relative to RNA produced using wild-type RNA polymerase. In some embodiments, RNA produced using a RNA polymerase variant (e.g., T7 RNAP S43A* variant and/or T7 RNAP G47A* variant) stimulates a cytokine response that is 50-60%, 50-70%, 50-80%, 50-90%, 50-100%, 60-70%, 60-80%, 60-90%, 60-100%, 70-80%, 70-90%, 70-100%, 80-90%, 80-100% or 90-100% lower relative to RNA produced using wild-type RNA polymerase. In some embodiments, RNA produced using a RNA polymerase variant (e.g., T7 RNAP S43A* variant and/or T7 RNAP G47A* variant) stimulates a cytokine response that is at least 2-fold, 3-fold, 4-fold or 5-fold lower relative to RNA produced using wild-type RNA polymerase.

In some embodiments, the cells used to test a cytokine response are human fibroblast cells (e.g., BJ (ATCC® CRL-2522™) cells). In some embodiments, the cells used to test a cytokine response are monocyte-derived macrophages (MDMs).

In some embodiments, the concentration of dsRNA transcript produced using a RNA polymerase variant is at least 50% (e.g., 55%, 60%, 65%, 70%, 75%, 80%, 85%, 90%, 95% or 100%) lower relative to dsRNA transcript produced using wild-type polymerase. In some embodiments, the concentration of dsRNA transcript produced is 50-60%, 50-70%, 50-80%, 50-90%, 50-100%, 60-70%, 60-80%, 60-90%, 60-100%, 70-80%, 70-90%, 70-100%, 80-90%, 80-100% or 90-100% lower relative to dsRNA transcript produced using wild-type polymerase. In some embodiments, the concentration of dsRNA transcript produced is at least 2-fold, 3-fold, 4-fold or 5-fold lower relative to dsRNA transcript produced using wild-type polymerase.

Use of the RNA polymerase variants of the present disclosure also resulted unexpectedly in the production of double stranded contaminants and fewer run-on transcripts.

In some embodiments, less than 50% (e.g., less than 45%, 40%, 35%, 30%, 25%, 20%, 15%, 10%, 5% or 1%) of the RNA transcript produced, e.g., by IVT, using a RNA polymerase variant is double-stranded contaminant. In some embodiments, 1-50%, 1-40%, 1-30%, 1-20%, 1-10%, 1-5%, 5-50%, 5-40%, 5-30%, 5-20%, 5-10%, 10-50%, 10-40%, 10-30% or 10-20% of the RNA transcript produced is double-stranded contaminant.

In some embodiments, less than 50% (e.g., less than 45%, 40%, 35%, 30%, 25%, 20%, 15%, 10%, 5% or 1%) of the RNA transcript produced using a RNA polymerase variant is run-on RNA transcript. In some embodiments, 1-50%, 1-40%, 1-30%, 1-20%, 1-10%, 1-5%, 5-50%, 5-40%, 5-30%, 5-20%, 5-10%, 10-50%, 10-40%, 10-30% or 10-20% of the RNA transcript produced is run-on RNA transcript.

In some embodiments, the amount of full-length RNA transcript produced using a RNA polymerase variant is at least 15 times greater than the amount of the DNA template. For example, the amount of full-length RNA transcript produced may be at least 20, 30, 40, 45, 50, 60, 70, 80, 90 or 100 times greater than the amount of the DNA template. In some embodiments, the amount of full-length RNA transcript produced is 15-100, 15-90, 15-80, 15-70, 15-60, 15-50, 15-40, 15-30, 15-20, 20-100, 20-90, 20-80, 20-70, 20-60, 20-50, 20-40 or 20-30 times greater than the amount of the DNA template. In some embodiments, the amount of full-length RNA transcript produced is 2-fold, 3-fold, 4-fold or 5-fold greater than the amount of the DNA template.

In some embodiments, the ratio of double-stranded contaminant:full-length RNA transcript produced using a RNA polymerase variant is less than 1:1. For example, the ratio of double-stranded contaminant:full-length RNA transcript produced may be 0.9:1, 0.8:1, 0.7:1, 0.6:1, 0.5:1, 0.4:1, 0.3:1, 0.2:1 or 0.1:1.

In some embodiments, the RNA transcript produced using a RNA polymerase variant has less than 1 mutation per 100 nucleotides relative to the DNA template. For example, the RNA transcript produced may have less than 1 mutation per 200, 300, 400, 500, 600, 700, 800, 900 or 1000 nucleotides relative to the DNA template.

RNA Polymerases

RNA polymerase (DNA-dependent RNA polymerase) is an enzyme that catalyzes the sequential addition of a ribonucleotide to the 3' end of a growing RNA chain (transcription of RNA in the 5'→3' direction), with nucleoside triphosphates (NTPs) acting as substrates for the enzyme and with the sequence of nucleotides specified by a DNA template. Transcription relies on the complementary pairing of bases. The two strands of a double helix separate locally, and one of the separated strands serves as a template (DNA template). RNA polymerase then catalyzes the alignment of free nucleotides on the DNA template by their complementary bases in the template. Thus, a RNA polymerase is considered to have RNA polymerase activity if the polymerase catalyzes the sequential addition of a ribonucleotide to the 3' end of a growing RNA chain.

T7 RNA polymerase (T7 RNAP) is a 99 kDa DNA-dependent RNA polymerase encoded by the genome of bacteriophage T7 and is highly specific for T7 phage promoters. Structural studies of T7 RNAP have shown that the conformation of the N-terminal domain changes substantially between the initiation phase and elongation phase of transcription. The N-terminal domain comprises a C-helix subdomain and the promoter binding domain, which includes two segments separated by subdomain H. The promoter binding domain and the bound promoter rotate by approximately 45 degrees upon synthesis of an 8-nt RNA transcript, allowing the promoter contacts to be maintained while the active site is expanded to accommodate a growing heteroduplex. The C-helix subdomain moves modestly toward its elongation conformation, whereas subdomain H remains in its initiation—rather than its elongation-phase location, more than 70 angstroms away. Comparison of the structures of the T7 RNAP initiation and elongation complexes reveal extensive conformational changes within the N-terminal 267 residues (N-terminal domain) and little change in the rest of the RNAP. A rigid body rotation of the promoter binding domain as well as the refolding of the N-terminal C-helix (residues 28-71) and H (residues 151-190) subdomains are responsible for abolishing the promoter binding site, enlarging the active site and creating an exit tunnel for the RNA transcript. The structural changes within the N-terminal domain account for the increased stability and the processivity of the elongation complex (see, e.g., Durniak, K. J. et al., *Science* 322(5901): 553-557, 2008, incorporated herein by reference).

Provided herein, in some aspects, are RNA polymerase variants (e.g., T7 RNAP variants) that facilitate the conformational change from the RNAP initiation complex to the RNAP elongation complex. A RNA polymerase variant is an enzyme having RNA polymerase activity and at least one substitution relative to the counterpart wild-type RNA polymerase. As indicated above, a RNA polymerase is considered to have RNA polymerase activity if the polymerase catalyzes the sequential addition of a ribonucleotide to the 3' end of a growing RNA chain. For example, an enzyme that includes the amino acid sequence SEQ ID NO:1 with an amino acid substitution at position S43 (e.g., S43A) or G47 (e.g., G47A) and maintains RNA polymerase activity is considered a T7 RNAP variant of wild-type T7 RNAP (SEQ ID NO:1).

In some embodiments, a RNA polymerase variant comprises at least one amino acid modification, relative to wild-type RNA polymerase, that causes at least one three-dimensional loop structure of the RNA polymerase variant to undergo a conformational change to a helix structure as the RNA polymerase variant transitions from an initiation complex to an elongation complex. Thus, in some embodiments, at least one amino acid modification has a high-helix propensity, relative to wild-type amino acid.

Examples of loop structures include but are not limited to amino acid (aa) 42-47 in the C-helix structure (e.g., aa 28-71 of SEQ ID NO:1) of the T7 RNA polymerase initiation complex (IC) conformation and aa 257-262 in the C-linker structure (e.g., aa 258-266 of SEQ ID NO:1) of the IC.

Also provided herein are RNA polymerase variants (e.g., T7 RNAP variants) that include at least one additional amino acid at the C terminus. The at least one additional amino acid, in some embodiments, is selected from alanine, arginine, asparagine, aspartic acid, cysteine, glutamic acid, glutamine, glycine, histidine, isoleucine, leucine, lysine, methionine, phenylalanine, proline, serine, threonine, tryptophan, tyrosine, and valine. In some embodiments, the at least one additional amino acid is a polar amino acid. In some embodiments, the at least one additional amino acid is a non-polar amino acid. In some embodiments, the at least one additional amino acid is glycine. In some embodiments, the at least one additional amino acid is alanine. In some embodiments, the at least one additional amino acid is serine.

In some embodiments, the C terminus of an RNA polymerase comprises the following consensus sequence: $FAFAX_n$ (SEQ ID NO:171), wherein x is any amino acid and n is any integer, e.g., between 1 and 5 (e.g., 1, 2, 3, 4, or 5). In some embodiments, the C terminus of an RNA polymerase comprises the following consensus sequence: $FAFAG_n$ (SEQ ID NO:330), wherein n is any integer, e.g., between 1 and 5. In some embodiments, the C terminus of an RNA polymerase comprises the following consensus sequence: $FAFAA_n$ (SEQ ID NO:331), wherein n is any integer, e.g., between 1 and 5. In some embodiments, the C terminus of an RNA polymerase comprises the following consensus sequence: $FAFAR_n$ (SEQ ID NO:332), wherein n is any integer, e.g., between 1 and 5. In some embodiments, the C terminus of an RNA polymerase comprises the following consensus sequence: $FAFAN_n$ (SEQ ID NO:333), wherein n is any integer, e.g., between 1 and 5. In some embodiments, the C terminus of an RNA polymerase comprises the following consensus sequence: $FAFAD_n$ (SEQ ID NO:334), wherein n is any integer, e.g., between 1 and 5. In some embodiments, the C terminus of an RNA polymerase comprises the following consensus sequence: $FAFAC_n$ (SEQ ID NO:335), wherein n is any integer, e.g., between 1 and 5. In some embodiments, the C terminus of an RNA polymerase comprises the following consensus sequence: $FAFAE_n$ (SEQ ID NO:336), wherein n is any integer, e.g., between 1 and 5. In some embodiments, the C terminus of an RNA polymerase comprises the following consensus sequence: $FAFAQ_n$ (SEQ ID NO:302), wherein n is any integer, e.g., between 1 and 5. In some embodiments, the C terminus of an RNA polymerase comprises the following consensus sequence: $FAFAH_n$ (SEQ ID NO:303), wherein n is any integer, e.g., between 1 and 5. In some embodiments, the C terminus of an RNA polymerase comprises the following consensus sequence: $FAFAI_n$ (SEQ ID NO:304), wherein n is any integer, e.g., between 1 and 5. In some embodiments, the C terminus of an RNA polymerase comprises the following consensus sequence: $FAFAL_n$ (SEQ ID NO:305), n is any integer, e.g., between 1 and 5. In some embodiments, the C terminus of an RNA polymerase comprises the following consensus sequence: $FAFAK_n$ (SEQ ID NO:306), wherein n is any integer, e.g., between 1 and 5. In some embodiments, the C terminus of an RNA polymerase comprises the following consensus sequence: $FAFAM_n$ (SEQ ID NO:307), wherein n is any integer, e.g., between 1 and 5. In some embodiments, the C terminus of an RNA polymerase comprises the following consensus sequence: $FAFAF_n$ (SEQ ID NO:308), wherein n is any integer, e.g., between 1 and 5. In some embodiments, the C terminus of an RNA polymerase comprises the following consensus sequence: FAFAP$_n$ (SEQ ID NO:309), wherein n is any integer, e.g., between 1 and 5. In some embodiments, the C terminus of an RNA polymerase comprises the following consensus sequence: FAFAS$_n$ (SEQ ID NO:310), wherein n is any integer, e.g., between 1 and 5. In some embodiments, the C terminus of an RNA polymerase comprises the following consensus sequence: FAFAT$_n$ (SEQ ID NO:311), wherein n is any integer, e.g., between 1 and 5. In some embodiments, the C terminus of an RNA polymerase comprises the following consensus sequence: FAFAW$_n$ (SEQ ID NO:312), wherein n is any integer, e.g., between 1 and 5. In some embodiments, the C terminus of an RNA polymerase comprises the following consensus sequence: FAFAY$_n$ (SEQ ID NO:313), n is any integer, e.g., between 1 and 5. In some embodiments, the C terminus of an RNA polymerase comprises the following consensus sequence: FAFAV$_n$ (SEQ ID NO:314), wherein n is any integer, e.g., between 1 and 5.

In some embodiments, the C-terminal motif (FAFA (SEQ ID NO: 172) or FAFAX$_n$ (SEQ ID NO: 171)) comprises an amino acid substitution at one or more of positions 880, 881, 882, or 883, relative to wild-type T7 RNAP (e.g., SEQ ID NO:1). Thus, the present disclosure comprises various C-terminal F$^{880}$A$^{881}$F$^{882}$A$^{883}$ (SEQ ID NO: 172) motifs, wherein the amino acid at one or more of positions 880, 881, 882, or 883 relative to wild-type T7 RNAP (e.g., SEQ ID NO:1) is modified to include at least one amino acid substitution, with or without an additional C-terminal amino acid (X$_n$).

Amino Acid Substitutions

RNA polymerase variants of the present disclosure include at least one amino acid substitution, relative to the WT RNA polymerase. For example, with reference to WT T7 RNA polymerase having an amino acid sequence of SEQ ID NO:1, the serine at position 43 is considered a "wild-type amino acid," whereas a substitution of the serine for alanine at position 43 is considered an "amino acid substitution" that has a high-helix propensity.

The average globular protein contains 30% α-helix, the most common type of secondary structure. Some amino acids occur more frequently in α-helices than others; this tendency is known as helix propensity. See, e.g., Pace, N.C. and Scholtz, J. M. Biophysical Journal, 75:422-427 (1998), incorporated herein by reference. In some embodiments, at least one amino acid substitution has a high-helix propensity, relative to wild-type amino acid. In general, high-helix propensity amino acid substitutions are selected to thermodynamically bias the population of polymerase conformers toward the elongation complex. The relative MGs (free energies) is calculated for substitutions in the IC and the elongation complex (EC) structures using publicly-available software (e.g., University of Washington's Rosetta and Schrödinger's Maestro). Substitutions are then selected based on the calculations and on additional knowledge, including for example, amino acid helix propensity and/or polypeptide backbone phi-psi compatibility.

In some embodiments, the RNA polymerase variant is a T7 RNA polymerase variant comprising at least one (one or more) amino acid substitution relative to WT T7 RNA polymerase (e.g., WT T7 RNA polymerase having an amino acid sequence of SEQ ID NO:1). In some embodiments, an amino acid substitution is a high-helix propensity amino acid substitution. Examples of high-helix propensity amino acids include alanine, isoleucine, leucine, arginine, methionine, lysine, glutamine, and/or glutamate.

In some embodiments, the RNA polymerase variant is a T7 RNA polymerase variant comprising at least one additional amino acid at the C terminus (e.g., SEQ ID NO:99, SEQ ID NO:100, SEQ ID NO:294, SEQ ID NO:295, or SEQ ID NO:296, or an amino acid sequence that shares 90%-99%, e.g., at least 90%, at least 95%, at least 96%, at least 97%, at least 98%, or at least 99% identity with SEQ ID NO:99, SEQ ID NO:100, SEQ ID NO:294, SEQ ID NO:295, or SEQ ID NO:296). In some embodiments, the RNA polymerase variant is a T7 RNA polymerase variant comprising at least one additional amino acid at the C terminus and an amino acid substitution relative to WT T7 RNA polymerase. In some embodiments, the amino acid substitution is a high-helix propensity amino acid substitution.

Provided herein are two approaches that may be used to identify high or higher helix propensity amino acid substitutions that thermodynamically bias/favor the conformational equilibrium toward the EC. In both approaches, care is taken to avoid making amino acid substitutions to any positions that are directly involved in promoter binding or catalysis (based on review of the structures, literature searches). In Method A, specialized software is used to compute the change in free energy of protein folding due to mutation ($\Delta\Delta G_{mut}$) in the EC and IC. All possible amino acid substitutions at the desired sequence positions are evaluated by this method. Desired amino acid substitutions (i.e., those that favor the EC over the IC) are those for which the $\Delta\Delta G_{mut}$ difference ($\Delta\Delta G_{mut}^{EC} - \Delta\Delta G_{mut}^{IC}$) is negative. In Method B, the IC and EC secondary structure annotations (e.g., as determined from 3D models of IC and EC tertiary structures using the DSSP software (Dictionary of protein secondary structure: pattern recognition of hydrogen-bonded and geometrical features. Kabsch W, Sander C, Biopolymers. 1983 22 2577-2637)) are inspected to identify regions with a loop in the IC and a helix in the EC. Sequence positions with low helix propensity residues (e.g., Gly) are then substituted with high helix propensity amino acids (e.g., Ala). For T7 RNAP, for example, mutational (e.g., substitutional) overlap from Methods A and B were identified as well as the top variant from Method B.

In some embodiments, the amino acid substitution is a high-helix propensity amino acid (e.g., alanine, isoleucine, leucine, arginine, methionine, lysine, glutamine, and/or glutamate) substitution at any one of amino acid positions 42-47 (E42, S43, Y44, E45, M46 and/or G47) of SEQ ID NO:1. In some embodiments, the amino acid substitution is a high-helix propensity amino acid (e.g., alanine, isoleucine, leucine, arginine, methionine, lysine, glutamine, and/or glutamate) substitution at any one of amino acid positions 42-47 (E42, S43, Y44, E45, M46 and/or G47) of an amino acid sequence that shares 90-99%, e.g., at least 90%, at least 95%, at least 96%, at least 97%, at least 98%, or at least 99% identity with SEQ ID NO:1. In some embodiments, the amino acid substitution is a high-helix propensity amino acid substitution at amino acid position 42 of SEQ ID NO:1. In some embodiments, the amino acid substitution is a high-helix propensity amino acid substitution at amino acid position 43 of SEQ ID NO:1. In some embodiments, the amino acid substitution is a high-helix propensity amino acid substitution at amino acid position 44 of SEQ ID NO:1. In some embodiments, the amino acid substitution is a high-helix propensity amino acid substitution at amino acid position 45 of SEQ ID NO:1. In some embodiments, the amino acid substitution is a high-helix propensity amino acid substitution at amino acid position 46 of SEQ ID NO:1. In some embodiments, the amino acid substitution is a high-helix propensity amino acid substitution at amino acid position 47 of SEQ ID NO:1.

In some embodiments, the amino acid substitution is a high-helix propensity amino acid (e.g., alanine, isoleucine, leucine, arginine, methionine, lysine, glutamine, and/or glutamate) substitution at any one of amino acid positions 42-47 (E42, S43, Y44, E45, M46 and/or G47) of SEQ ID NO:99, 100, 294, 295, or 296. In some embodiments, the amino acid substitution is a high-helix propensity amino acid (e.g., alanine, isoleucine, leucine, arginine, methionine, lysine, glutamine, and/or glutamate) substitution at any one of amino acid positions 42-47 (E42, S43, Y44, E45, M46 and/or G47) of an amino acid sequence that shares 90-99%, e.g., at least 90%, at least 95%, at least 96%, at least 97%, at least 98%, or at least 99% identity with SEQ ID NO:99, 100, 294, 295, or 296. In some embodiments, the amino acid substitution is a high-helix propensity amino acid substitution at amino acid position 42 of SEQ ID NO:99, 100, 294, 295, or 296. In some embodiments, the amino acid substitution is a high-helix propensity amino acid substitution at amino acid position 43 of SEQ ID NO:99, 100, 294, 295, or 296. In some embodiments, the amino acid substitution is a high-helix propensity amino acid substitution at amino acid position 44 of SEQ ID NO:99, 100, 294, 295, or 296. In some embodiments, the amino acid substitution is a high-helix propensity amino acid substitution at amino acid position 45 of SEQ ID NO:99, 100, 294, 295, or 296. In some embodiments, the amino acid substitution is a high-helix propensity amino acid substitution at amino acid position 46 of SEQ ID NO:99, 100, 294, 295, or 296. In some embodiments, the amino acid substitution is a high-helix propensity amino acid substitution at amino acid position 47 of SEQ ID NO:99, 100, 294, 295, or 296.

In some embodiments, the amino acid substitution is an alanine at any one of amino acid positions 42-47 of SEQ ID NO:1. In some embodiments, the amino acid substitution is an alanine at any one of amino acid positions 42-47 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is an alanine at position 42 of SEQ ID NO:1. In some embodiments, the amino acid substitution is an alanine at position 43 of SEQ ID NO:1. In some embodiments, the amino acid substitution is an alanine at position 44 of SEQ ID NO:1. In some embodiments, the amino acid substitution is an alanine at position 45 of SEQ ID NO:1. In some embodiments, the amino acid substitution is an alanine at position 46 of SEQ ID NO:1. In some embodiments, the amino acid substitution is an alanine at position 47 of SEQ ID NO:1.

In some embodiments, the amino acid substitution is an alanine at any one of amino acid positions 42-47 of SEQ ID NO:99, 100, 294, 295, or 296. In some embodiments, the amino acid substitution is an alanine at any one of amino acid positions 42-47 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is an alanine at position 42 of SEQ ID NO:99, 100, 294, 295, or 296. In some embodiments, the amino acid substitution is an alanine at position 43 of SEQ ID NO:99, 100, 294, 295, or 296. In some embodiments, the amino acid substitution is an alanine at position 44 of SEQ ID NO:99, 100, 294, 295, or 296. In some embodiments, the amino acid substitution is an alanine at position 45 of SEQ ID NO:99, 100, 294, 295, or 296. In some embodiments, the amino acid substitution is an alanine at position 46 of SEQ ID NO:99, 100, 294, 295, or 296. In some embodiments, the amino acid substitution is an alanine at position 47 of SEQ ID NO:99, 100, 294, 295, or 296.

In some embodiments, the amino acid substitution is an isoleucine at any one of amino acid positions 42-47 of SEQ ID NO:1. In some embodiments, the amino acid substitution is an isoleucine at any one of amino acid positions 42-47 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is an isoleucine at position 42 of SEQ ID NO:1. In some embodiments, the amino acid substitution is an isoleucine at position 43 of SEQ ID NO:1. In some embodiments, the amino acid substitution is an isoleucine at position 44 of SEQ ID NO:1. In some embodiments, the amino acid substitution is an isoleucine at position 45 of SEQ ID NO:1. In some embodiments, the amino acid substitution is an isoleucine at position 46 of SEQ ID NO:1. In some embodiments, the amino acid substitution is an isoleucine at position 47 of SEQ ID NO:1.

In some embodiments, the amino acid substitution is an isoleucine at any one of amino acid positions 42-47 of SEQ ID NO:99, 100, 294, 295, or 296. In some embodiments, the amino acid substitution is an isoleucine at any one of amino acid positions 42-47 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is an isoleucine at position 42 of SEQ ID NO:99, 100, 294, 295, or 296. In some embodiments, the amino acid substitution is an isoleucine at position 43 of SEQ ID NO:99, 100, 294, 295, or 296. In some embodiments, the amino acid substitution is an isoleucine at position 44 of SEQ ID NO:99, 100, 294, 295, or 296. In some embodiments, the amino acid substitution is an isoleucine at position 45 of SEQ ID NO:99, 100, 294, 295, or 296. In some embodiments, the amino acid substitution is an isoleucine at position 46 of SEQ ID NO:99, 100, 294, 295, or 296. In some embodiments, the amino acid substitution is an isoleucine at position 47 of SEQ ID NO:99, 100, 294, 295, or 296.

In some embodiments, the amino acid substitution is a leucine at any one of amino acid positions 42-47 of SEQ ID NO:1. In some embodiments, the amino acid substitution is a leucine at any one of amino acid positions 42-47 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a leucine at position 42 of SEQ ID NO:1. In some embodiments, the amino acid substitution is a leucine at position 43 of SEQ ID NO:1. In some embodiments, the amino acid substitution is a leucine at position 44 of SEQ ID NO:1. In some embodiments, the amino acid substitution is a leucine at position 45 of SEQ ID NO:1. In some embodiments, the amino acid substitution is a leucine at position 46 of SEQ ID NO:1. In some embodiments, the amino acid substitution is a leucine at position 47 of SEQ ID NO:1.

In some embodiments, the amino acid substitution is a leucine at any one of amino acid positions 42-47 of SEQ ID NO:99, 100, 294, 295, or 296. In some embodiments, the amino acid substitution is a leucine at any one of amino acid positions 42-47 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a leucine at position 42 of SEQ ID NO:99, 100, 294, 295, or 296. In some embodiments, the amino acid substitution is a leucine at position 43 of SEQ ID NO:99, 100, 294, 295, or 296. In some embodiments, the amino acid substitution is a leucine at position 44 of SEQ ID NO:99, 100, 294, 295, or 296. In some embodiments, the amino acid substitution is a leucine at position 45 of SEQ ID NO:99, 100, 294, 295, or 296. In some embodiments, the amino acid substitution is a leucine at position 46 of SEQ ID NO:99, 100, 294, 295, or 296. In some embodiments, the amino acid substitution is a leucine at position 47 of SEQ ID NO:99, 100, 294, 295, or 296.

In some embodiments, the amino acid substitution is an arginine at any one of amino acid positions 42-47 of SEQ ID NO:1. In some embodiments, the amino acid substitution is an arginine at any one of amino acid positions 42-47 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is an arginine at position 42 of SEQ ID NO:1. In some embodiments, the amino acid substitution is an arginine at position 43 of SEQ ID NO:1. In some embodiments, the amino acid substitution is an arginine at position 44 of SEQ ID NO:1. In some embodiments, the amino acid substitution is an arginine at position 45 of SEQ ID NO:1. In some embodiments, the amino acid substitution is an arginine at position 46 of SEQ ID NO:1. In some embodiments, the amino acid substitution is an arginine at position 47 of SEQ ID NO:1.

In some embodiments, the amino acid substitution is an arginine at any one of amino acid positions 42-47 of SEQ ID NO:99, 100, 294, 295, or 296. In some embodiments, the amino acid substitution is an arginine at any one of amino acid positions 42-47 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is an arginine at position 42 of SEQ ID NO:99, 100, 294, 295, or 296. In some embodiments, the amino acid substitution is an arginine at position 43 of SEQ ID NO:99, 100, 294, 295, or 296. In some embodiments, the amino acid substitution is an arginine at position 44 of SEQ ID NO:99, 100, 294, 295, or 296. In some embodiments, the amino acid substitution is an arginine at position 45 of SEQ ID NO:99, 100, 294, 295, or 296. In some embodiments, the amino acid substitution is an arginine at position 46 of SEQ ID NO:99, 100, 294, 295, or 296. In some embodiments, the amino acid substitution is an arginine at position 47 of SEQ ID NO:99, 100, 294, 295, or 296.

In some embodiments, the amino acid substitution is a methionine at any one of amino acid positions 42-47 of SEQ ID NO:1. In some embodiments, the amino acid substitution is a methionine at any one of amino acid positions 42-47 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a methionine at position 42 of SEQ ID NO:1. In some embodiments, the amino acid substitution is a methionine at position 43 of SEQ ID NO:1. In some embodiments, the amino acid substitution is a methionine at position 44 of SEQ ID NO:1. In some embodiments, the amino acid substitution is a methionine at position 45 of SEQ ID NO:1. In some embodiments, the amino acid substitution is a methionine at position 46 of SEQ ID NO:1. In some embodiments, the amino acid substitution is a methionine at position 47 of SEQ ID NO:1.

In some embodiments, the amino acid substitution is a methionine at any one of amino acid positions 42-47 of SEQ ID NO:99, 100, 294, 295, or 296. In some embodiments, the amino acid substitution is a methionine at any one of amino acid positions 42-47 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a methionine at position 42 of SEQ ID NO:99, 100, 294, 295, or 296. In some embodiments, the amino acid substitution is a methionine at position 43 of SEQ ID NO:99, 100, 294, 295, or 296. In some embodiments, the amino acid substitution is a methionine at position 44 of SEQ ID NO:99, 100, 294, 295, or 296. In some embodiments, the amino acid substitution is a methionine at position 45 of SEQ ID NO:99, 100, 294, 295, or 296. In some embodiments, the amino acid substitution is a methionine at position 46 of SEQ ID NO:99, 100, 294, 295, or 296. In some embodiments, the amino acid substitution is a methionine at position 47 of SEQ ID NO:99, 100, 294, 295, or 296.

In some embodiments, the amino acid substitution is a lysine at any one of amino acid positions 42-47 of SEQ ID NO:1. In some embodiments, the amino acid substitution is a lysine at any one of amino acid positions 42-47 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a lysine at position 42 of SEQ ID NO:1. In some embodiments, the amino acid substitution is a lysine at position 43 of SEQ ID NO:1. In some embodiments, the amino acid substitution is a lysine at position 44 of SEQ ID NO:1. In some embodiments, the amino acid substitution is a lysine at position 45 of SEQ ID NO:1. In some embodiments, the amino acid substitution is a lysine at position 46 of SEQ ID NO:1. In some embodiments, the amino acid substitution is a lysine at position 47 of SEQ ID NO:1.

In some embodiments, the amino acid substitution is a lysine at any one of amino acid positions 42-47 of SEQ ID NO:99, 100, 294, 295, or 296. In some embodiments, the amino acid substitution is a lysine at any one of amino acid positions 42-47 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a lysine at position 42 of SEQ ID NO:99, 100, 294, 295, or 296. In some embodiments, the amino acid substitution is a lysine at position 43 of SEQ ID NO:99, 100, 294, 295, or 296. In some embodiments, the amino acid substitution is a lysine at position 44 of SEQ ID NO:99, 100, 294, 295, or 296. In some embodiments, the amino acid substitution is a lysine at position 45 of SEQ ID NO:99, 100, 294, 295, or 296. In some embodiments, the amino acid substitution is a lysine at position 46 of SEQ ID NO:99, 100, 294, 295, or 296. In some embodiments, the amino acid substitution is a lysine at position 47 of SEQ ID NO:99, 100, 294, 295, or 296.

In some embodiments, the amino acid substitution is a glutamine at any one of amino acid positions 42-47 of SEQ ID NO:1. In some embodiments, the amino acid substitution is a glutamine at any one of amino acid positions 42-47 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a glutamine at position 42 of SEQ ID NO:1. In some embodiments, the amino acid substitution is a glutamine at position 43 of SEQ ID NO:1. In some embodiments, the amino acid substitution is a glutamine at position 44 of SEQ ID NO:1. In some embodiments, the amino acid substitution is a glutamine at position 45 of SEQ ID NO:1. In some embodiments, the amino acid substitution is a glutamine at position 46 of SEQ ID NO:1. In some embodiments, the amino acid substitution is a glutamine at position 47 of SEQ ID NO:1.

In some embodiments, the amino acid substitution is a glutamine at any one of amino acid positions 42-47 of SEQ ID NO:99, 100, 294, 295, or 296. In some embodiments, the amino acid substitution is a glutamine at any one of amino acid positions 42-47 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a glutamine at position 42 of SEQ ID NO:99, 100, 294, 295, or 296. In some embodiments, the amino acid substitution is a glutamine at position 43 of SEQ ID NO:99, 100, 294, 295, or 296. In some embodiments, the amino acid substitution is a glutamine at position 44 of SEQ ID NO:99, 100, 294, 295, or 296. In some embodiments, the amino acid substitution is a glutamine at position 45 of SEQ ID NO:99, 100, 294, 295, or 296. In some embodiments, the amino acid substitution is a glutamine at position 46 of SEQ ID NO:99, 100, 294, 295, or 296. In some embodiments, the amino acid substitution is a glutamine at position 47 of SEQ ID NO:99, 100, 294, 295, or 296.

In some embodiments, the amino acid substitution is a glutamate at any one of amino acid positions 42-47 of SEQ ID NO:1. In some embodiments, the amino acid substitution is a glutamate at any one of amino acid positions 42-47 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a glutamate at position 42 of SEQ ID NO:1. In some embodiments, the amino acid substitution is a glutamate at position 43 of SEQ ID NO:1. In some embodiments, the amino acid substitution is a glutamate at position 44 of SEQ ID NO:1. In some embodiments, the amino acid substitution is a glutamate at position 45 of SEQ ID NO:1. In some embodiments, the amino acid substitution is a glutamate at position 46 of SEQ ID NO:1. In some embodiments, the amino acid substitution is a glutamate at position 47 of SEQ ID NO:1.

In some embodiments, the amino acid substitution is a glutamate at any one of amino acid positions 42-47 of SEQ ID NO:99, 100, 294, 295, or 296. In some embodiments, the amino acid substitution is a glutamate at any one of amino acid positions 42-47 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a glutamate at position 42 of SEQ ID NO:99, 100, 294, 295, or 296. In some embodiments, the amino acid substitution is a glutamate at position 43 of SEQ ID NO:99, 100, 294, 295, or 296. In some embodiments, the amino acid substitution is a glutamate at position 44 of SEQ ID NO:99, 100, 294, 295, or 296. In some embodiments, the amino acid substitution is a glutamate at position 45 of SEQ ID NO:99, 100, 294, 295, or 296. In some embodiments, the amino acid substitution is a glutamate at position 46 of SEQ ID NO:99, 100, 294, 295, or 296. In some embodiments, the amino acid substitution is a glutamate at position 47 of SEQ ID NO:99, 100, 294, 295, or 296.

In some embodiments, the amino acid substitution is a high-helix propensity amino acid (e.g., alanine, isoleucine, leucine, arginine, methionine, lysine, glutamine, and/or glutamate) substitution at any one of amino acid positions 257-262 (R257, A258, G259, A260, L261 and/or A262) of SEQ ID NO:1. In some embodiments, the amino acid substitution is a high-helix propensity amino acid (e.g., alanine, isoleucine, leucine, arginine, methionine, lysine, glutamine, and/or glutamate) substitution at any one of amino acid positions 257-262 (R257, A258, G259, A260, L261 and/or A262) of an amino acid sequence that shares 90-99%, e.g., at least 90%, at least 95%, at least 96%, at least 97%, at least 98%, or at least 99% identity with SEQ ID NO:1. In some embodiments, the amino acid substitution is a high-helix propensity amino acid substitution at amino acid position 257 of SEQ ID NO:1. In some embodiments, the amino acid substitution is a high-helix propensity amino acid substitution at amino acid position 258 of SEQ ID NO:1. In some embodiments, the amino acid substitution is a high-helix propensity amino acid substitution at amino acid position 259 of SEQ ID NO:1. In some embodiments, the amino acid substitution is a high-helix propensity amino acid substitution at amino acid position 260 of SEQ ID NO:1. In some embodiments, the amino acid substitution is a high-helix propensity amino acid substitution at amino acid position 261 of SEQ ID NO:1. In some embodiments, the amino acid substitution is a high-helix propensity amino acid substitution at amino acid position 262 of SEQ ID NO:1.

In some embodiments, the amino acid substitution is a high-helix propensity amino acid (e.g., alanine, isoleucine, leucine, arginine, methionine, lysine, glutamine, and/or glutamate) substitution at any one of amino acid positions 257-262 (R257, A258, G259, A260, L261 and/or A262) of SEQ ID NO:99, 100, 294, 295, or 296. In some embodiments, the amino acid substitution is a high-helix propensity amino acid (e.g., alanine, isoleucine, leucine, arginine, methionine, lysine, glutamine, and/or glutamate) substitution at any one of amino acid positions 257-262 (R257, A258, G259, A260, L261 and/or A262) of an amino acid sequence that shares 90-99%, e.g., at least 90%, at least 95%, at least 96%, at least 97%, at least 98%, or at least 99% identity with SEQ ID NO:99, 100, 294, 295, or 296. In some embodiments, the amino acid substitution is a high-helix propensity amino acid substitution at amino acid position 257 of SEQ ID NO:99, 100, 294, 295, or 296. In some embodiments, the amino acid substitution is a high-helix propensity amino acid substitution at amino acid position 258 of SEQ ID NO:99, 100, 294, 295, or 296. In some embodiments, the amino acid substitution is a high-helix propensity amino acid substitution at amino acid position 259 of SEQ ID NO:99, 100, 294, 295, or 296. In some embodiments, the amino acid substitution is a high-helix propensity amino acid substitution at amino acid position 260 of SEQ ID NO:99, 100, 294, 295, or 296. In some embodiments, the amino acid substitution is a high-helix propensity amino acid substitution at amino acid position 261 of SEQ ID NO:99, 100, 294, 295, or 296. In some embodiments, the amino acid substitution is a high-helix propensity amino acid substitution at amino acid position 262 of SEQ ID NO:99, 100, 294, 295, or 296.

In some embodiments, the amino acid substitution is an alanine at any one of amino acid positions 257-262 of SEQ ID NO:1. In some embodiments, the amino acid substitution is an alanine at any one of amino acid positions 257-262 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is an alanine at position 257 of SEQ ID NO:1. In some embodiments, the amino acid substitution is an alanine at position 258 of SEQ ID NO:1. In some embodiments, the amino acid substitution is an alanine at position 259 of SEQ ID NO:1. In some embodiments, the amino acid substitution is an alanine at position 260 of SEQ ID NO:1. In some embodiments, the amino acid substitution is an alanine at position 261 of SEQ ID NO:1. In some embodiments, the amino acid substitution is an alanine at position 262 of SEQ ID NO:1.

In some embodiments, the amino acid substitution is an alanine at any one of amino acid positions 257-262 of SEQ ID NO:99, 100, 294, 295, or 296. In some embodiments, the amino acid substitution is an alanine at any one of amino acid positions 257-262 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is an alanine at position 257 of SEQ ID NO:99, 100, 294, 295, or 296. In some embodiments, the amino acid substitution is an alanine at position 258 of SEQ ID NO:99, 100, 294, 295, or 296. In some embodiments, the amino acid substitution is an alanine at position 259 of SEQ ID NO:99, 100, 294, 295, or 296. In some embodiments, the amino acid substitution is an alanine at position 260 of SEQ ID NO:99, 100, 294, 295, or 296. In some embodiments, the amino acid substitution is an alanine at position 261 of SEQ ID NO:99, 100, 294, 295, or 296. In some embodiments, the amino acid substitution is an alanine at position 262 of SEQ ID NO:99, 100, 294, 295, or 296.

In some embodiments, the amino acid substitution is an isoleucine at any one of amino acid positions 257-262 of SEQ ID NO:1. In some embodiments, the amino acid substitution is an isoleucine at any one of amino acid positions 257-262 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is an isoleucine at position 257 of SEQ ID NO:1. In some embodiments, the amino acid substitution is an isoleucine at position 258 of SEQ ID NO:1. In some embodiments, the amino acid substitution is an isoleucine at position 259 of SEQ ID NO:1. In some embodiments, the amino acid substitution is an isoleucine at position 260 of SEQ ID NO:1. In some embodiments, the amino acid substitution is an isoleucine at position 261 of SEQ ID NO:1. In some embodiments, the amino acid substitution is an isoleucine at position 262 of SEQ ID NO:1.

In some embodiments, the amino acid substitution is an isoleucine at any one of amino acid positions 257-262 of SEQ ID NO:99, 100, 294, 295, or 296. In some embodiments, the amino acid substitution is an isoleucine at any one of amino acid positions 257-262 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is an isoleucine at position 257 of SEQ ID NO:99, 100, 294, 295, or 296. In some embodiments, the amino acid substitution is an isoleucine at position 258 of SEQ ID NO:99, 100, 294, 295, or 296. In some embodiments, the amino acid substitution is an isoleucine at position 259 of SEQ ID NO:99, 100, 294, 295, or 296. In some embodiments, the amino acid substitution is an isoleucine at position 260 of SEQ ID NO:99, 100, 294, 295, or 296. In some embodiments, the amino acid substitution is an isoleucine at position 261 of SEQ ID NO:99, 100, 294, 295, or 296. In some embodiments, the amino acid substitution is an isoleucine at position 262 of SEQ ID NO:99, 100, 294, 295, or 296.

In some embodiments, the amino acid substitution is a leucine at any one of amino acid positions 257-262 of SEQ ID NO:1. In some embodiments, the amino acid substitution is a leucine at any one of amino acid positions 257-262 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a leucine at position 257 of SEQ ID NO:1. In some embodiments, the amino acid substitution is a leucine at position 258 of SEQ ID NO:1. In some embodiments, the amino acid substitution is a leucine at position 259 of SEQ ID NO:1. In some embodiments, the amino acid substitution is a leucine at position 260 of SEQ ID NO:1. In some embodiments, the amino acid substitution is a leucine at position 261 of SEQ ID NO:1. In some embodiments, the amino acid substitution is a leucine at position 262 of SEQ ID NO:1.

In some embodiments, the amino acid substitution is a leucine at any one of amino acid positions 257-262 of SEQ ID NO:99, 100, 294, 295, or 296. In some embodiments, the amino acid substitution is a leucine at any one of amino acid positions 257-262 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a leucine at position 257 of SEQ ID NO:99, 100, 294, 295, or 296. In some embodiments, the amino acid substitution is a leucine at position 258 of SEQ ID NO:99, 100, 294, 295, or 296. In some embodiments, the amino acid substitution is a leucine at position 259 of SEQ ID NO:99, 100, 294, 295, or 296. In some embodiments, the amino acid substitution is a leucine at position 260 of SEQ ID NO:99, 100, 294, 295, or 296. In some embodiments, the amino acid substitution is a leucine at position 261 of SEQ ID NO:99, 100, 294, 295, or 296. In some embodiments, the amino acid substitution is a leucine at position 262 of SEQ ID NO:99, 100, 294, 295, or 296.

In some embodiments, the amino acid substitution is an arginine at any one of amino acid positions 257-262 of SEQ ID NO:1. In some embodiments, the amino acid substitution is a arginine at any one of amino acid positions 257-262 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is an arginine at position 257 of SEQ ID NO:1. In some embodiments, the amino acid substitution is an arginine at position 258 of SEQ ID NO:1. In some embodiments, the amino acid substitution is an arginine at position 259 of SEQ ID NO:1. In some embodiments, the amino acid substitution is an arginine at position 260 of SEQ ID NO:1. In some embodiments, the amino acid substitution is an arginine at position 261 of SEQ ID NO:1. In some embodiments, the amino acid substitution is an arginine at position 262 of SEQ ID NO:1.

In some embodiments, the amino acid substitution is an arginine at any one of amino acid positions 257-262 of SEQ ID NO:99, 100, 294, 295, or 296. In some embodiments, the amino acid substitution is an arginine at any one of amino acid positions 257-262 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is an arginine at position 257 of SEQ ID NO:99, 100, 294, 295, or 296. In some embodiments, the amino acid substitution is an arginine at position 258 of SEQ ID NO:99, 100, 294, 295, or 296. In some embodiments, the amino acid substitution is an arginine at position 259 of SEQ ID NO:99, 100, 294, 295, or 296. In some embodiments, the amino acid substitution is an arginine at position 260 of SEQ ID NO:99, 100, 294, 295, or 296. In some embodiments, the amino acid substitution is an arginine at position 261 of SEQ ID NO:99, 100, 294, 295, or 296. In some embodiments, the amino acid substitution is an arginine at position 262 of SEQ ID NO:99, 100, 294, 295, or 296.

In some embodiments, the amino acid substitution is a methionine at any one of amino acid positions 257-262 of SEQ ID NO:1. In some embodiments, the amino acid substitution is a methionine at any one of amino acid positions 257-262 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a methionine at position 257 of SEQ ID NO:1. In some embodiments, the amino acid substitution is a methionine at position 258 of SEQ ID NO:1. In some embodiments, the amino acid substitution is a methionine at position 259 of SEQ ID NO:1. In some embodiments, the amino acid substitution is a methionine at position 260 of SEQ ID NO:1. In some embodiments, the amino acid substitution is a methionine at position 261 of SEQ ID NO:1. In some embodiments, the amino acid substitution is a methionine at position 262 of SEQ ID NO:1.

In some embodiments, the amino acid substitution is a methionine at any one of amino acid positions 257-262 of SEQ ID NO:99, 100, 294, 295, or 296. In some embodiments, the amino acid substitution is a methionine at any one of amino acid positions 257-262 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a methionine at position 257 of SEQ ID NO:99, 100, 294, 295, or 296. In some embodiments, the amino acid substitution is a methionine at position 258 of SEQ ID NO:99, 100, 294, 295, or 296. In some embodiments, the amino acid substitution is a methionine at position 259 of SEQ ID NO:99, 100, 294, 295, or 296. In some embodiments, the amino acid substitution is a methionine at position 260 of SEQ ID NO:99, 100, 294, 295, or 296. In some embodiments, the amino acid substitution is a methionine at position 261 of SEQ ID NO:99, 100, 294, 295, or 296. In some embodiments, the amino acid substitution is a methionine at position 262 of SEQ ID NO:99, 100, 294, 295, or 296.

In some embodiments, the amino acid substitution is a lysine at any one of amino acid positions 257-262 of SEQ ID NO:1. In some embodiments, the amino acid substitution is a lysine at any one of amino acid positions 257-262 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a lysine at position 257 of SEQ ID NO:1. In some embodiments, the amino acid substitution is a lysine at position 258 of SEQ ID NO:1. In some embodiments, the amino acid substitution is a lysine at position 259 of SEQ ID NO:1. In some embodiments, the amino acid substitution is a lysine at position 260 of SEQ ID NO:1. In some embodiments, the amino acid substitution is a lysine at position 261 of SEQ ID NO:1. In some embodiments, the amino acid substitution is a lysine at position 262 of SEQ ID NO:1.

In some embodiments, the amino acid substitution is a lysine at any one of amino acid positions 257-262 of SEQ ID NO:99, 100, 294, 295, or 296. In some embodiments, the amino acid substitution is a lysine at any one of amino acid positions 257-262 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a lysine at position 257 of SEQ ID NO:99, 100, 294, 295, or 296. In some embodiments, the amino acid substitution is a lysine at position 258 of SEQ ID NO:99, 100, 294, 295, or 296. In some embodiments, the amino acid substitution is a lysine at position 259 of SEQ ID NO:99, 100, 294, 295, or 296. In some embodiments, the amino acid substitution is a lysine at position 260 of SEQ ID NO:99, 100, 294, 295, or 296. In some embodiments, the amino acid substitution is a lysine at position 261 of SEQ ID NO:99, 100, 294, 295, or 296. In some embodiments, the amino acid substitution is a lysine at position 262 of SEQ ID NO:99, 100, 294, 295, or 296.

In some embodiments, the amino acid substitution is a glutamine at any one of amino acid positions 257-262 of SEQ ID NO:1. In some embodiments, the amino acid substitution is a glutamine at any one of amino acid positions 257-262 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a glutamine at position 257 of SEQ ID NO:1. In some embodiments, the amino acid substitution is a glutamine at position 258 of SEQ ID NO:1. In some embodiments, the amino acid substitution is a glutamine at position 259 of SEQ ID NO:1. In some embodiments, the amino acid substitution is a glutamine at position 260 of SEQ ID NO:1. In some embodiments, the amino acid substitution is a glutamine at position 261 of SEQ ID NO:1. In some embodiments, the amino acid substitution is a glutamine at position 262 of SEQ ID NO:1.

In some embodiments, the amino acid substitution is a glutamine at any one of amino acid positions 257-262 of SEQ ID NO:99, 100, 294, 295, or 296. In some embodiments, the amino acid substitution is a glutamine at any one of amino acid positions 257-262 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a glutamine at position 257 of SEQ ID NO:99, 100, 294, 295, or 296. In some embodiments, the amino acid substitution is a glutamine at position 258 of SEQ ID NO:99, 100, 294, 295, or 296. In some embodiments, the amino acid substitution is a glutamine at position 259 of SEQ ID NO:99, 100, 294, 295, or 296. In some embodiments, the amino acid substitution is a glutamine at position 260 of SEQ ID NO:99, 100, 294, 295, or 296. In some embodiments, the amino acid substitution is a glutamine at position 261 of SEQ ID NO:99, 100, 294, 295, or 296. In some embodiments, the amino acid substitution is a glutamine at position 262 of SEQ ID NO:99, 100, 294, 295, or 296.

In some embodiments, the amino acid substitution is a glutamate at any one of amino acid positions 257-262 of SEQ ID NO:1. In some embodiments, the amino acid substitution is a glutamate at any one of amino acid positions 257-262 of an amino acid sequence that shares 90-99%, e.g., at least 90%, at least 95%, at least 96%, at least 97%, at least 98%, or at least 99% identity with SEQ ID NO:1. Thus, in some embodiments, the amino acid substitution is a glutamate at position 257 of SEQ ID NO:1. In some embodiments, the amino acid substitution is a glutamate at position 258 of SEQ ID NO:1. In some embodiments, the amino acid substitution is a glutamate at position 259 of SEQ ID NO:1. In some embodiments, the amino acid substitution is a glutamate at position 260 of SEQ ID NO:1. In some embodiments, the amino acid substitution is a glutamate at position 261 of SEQ ID NO:1. In some embodiments, the amino acid substitution is a glutamate at position 262 of SEQ ID NO:1.

In some embodiments, the amino acid substitution is a glutamate at any one of amino acid positions 257-262 of SEQ ID NO:99, 100, 294, 295, or 296. In some embodiments, the amino acid substitution is a glutamate at any one of amino acid positions 257-262 of an amino acid sequence that shares 90-99%, e.g., at least 90%, at least 95%, at least 96%, at least 97%, at least 98%, or at least 99% identity with SEQ ID NO:99, 100, 294, 295, or 296. Thus, in some embodiments, the amino acid substitution is a glutamate at position 257 of SEQ ID NO:99, 100, 294, 295, or 296. In some embodiments, the amino acid substitution is a glutamate at position 258 of SEQ ID NO:99, 100, 294, 295, or 296. In some embodiments, the amino acid substitution is a glutamate at position 259 of SEQ ID NO:99, 100, 294, 295, or 296. In some embodiments, the amino acid substitution is a glutamate at position 260 of SEQ ID NO:99, 100, 294, 295, or 296. In some embodiments, the amino acid substitution is a glutamate at position 261 of SEQ ID NO:99, 100, 294, 295, or 296. In some embodiments, the amino acid substitution is a glutamate at position 262 of SEQ ID NO:99, 100, 294, 295, or 296.

In some embodiments, the T7 RNA polymerase variant comprises an amino acid sequence of SEQ ID NO:1 modified to include an amino acid substitution of a high-helix propensity amino acid at position G47, S43, R257, and/or G259. In some embodiments, the T7 RNA polymerase variant comprises an amino acid sequence that shares 90-99%, e.g., at least 90%, at least 95%, at least 96%, at least 97%, at least 98%, or at least 99% identity with SEQ ID NO:1 modified to include an amino acid substitution of a high-helix propensity amino acid at position G47, S43, R257, and/or G259.

In some embodiments, the T7 RNA polymerase variant comprises an amino acid sequence of SEQ ID NO:99, 100, 294, 295, or 296 modified to include an amino acid substitution of a high-helix propensity amino acid at position G47, S43, R257, and/or G259. In some embodiments, the T7 RNA polymerase variant comprises an amino acid sequence that shares 90-99%, e.g., at least 90%, at least 95%, at least 96%, at least 97%, at least 98%, or at least 99% identity with SEQ ID NO:99, 100, 294, 295, or 296 modified to include an amino acid substitution of a high-helix propensity amino acid at position G47, S43, R257, and/or G259.

In some embodiments, a T7 RNA polymerase variant comprises an amino acid sequence of SEQ ID NO:2. In some embodiments, a T7 RNA polymerase variant comprises an amino acid sequence of SEQ ID NO:3. In some embodiments, a T7 RNA polymerase variant comprises an amino acid sequence of SEQ ID NO:4. In some embodiments, a T7 RNA polymerase variant comprises an amino acid sequence of SEQ ID NO:5.

In some embodiments, a T7 RNA polymerase variant comprises an amino acid sequence of SEQ ID NO:107 or 108. In some embodiments, a T7 RNA polymerase variant comprises an amino acid sequence of SEQ ID NO:109 or 110. In some embodiments, a T7 RNA polymerase variant comprises an amino acid sequence of SEQ ID NO:111 or 112. In some embodiments, a T7 RNA polymerase variant comprises an amino acid sequence of SEQ ID NO:113 or 114.

Also provided herein are RNA polymerase variants with at least 2 (2 or more) substitutions. In some embodiments, a RNA polymerase comprise at least 2 high-helix propensity amino acid (e.g., alanine, isoleucine, leucine, arginine, methionine, lysine, glutamine, and/or glutamate) substitutions at any one of amino acid positions 42-47 (E42, S43, Y44, E45, M46 and/or G47) and/or amino acid positions 257-262 (R257, A258, G259, A260, L261 and/or A262) of SEQ ID NO:1 or an amino acid sequence that shares 90-99%, e.g., at least 90%, at least 95%, at least 96%, at least 97%, at least 98%, or at least 99% identity with SEQ ID NO:1.

For example, a RNA polymerase variant may comprise an amino acid substitution (e.g., alanine, isoleucine, leucine, arginine, methionine, lysine, glutamine, and/or glutamate) at positions E42 and S43, E42 and Y44, E42 and E45, E42 and M46, E42 and G47, S43 and Y44, S43 and E45, S43 and M46, S43 and G47, Y44 and E45, Y44 and M46, Y44 and G47, E45 and M46, E45 and G47, or M46 and G47 of SEQ ID NO:1 or an amino acid sequence that shares 90-99%, e.g., at least 90%, at least 95%, at least 96%, at least 97%, at least 98%, or at least 99% identity with SEQ ID NO:1.

In some embodiments, a RNA polymerase variant comprises an amino acid substitution (e.g., alanine, isoleucine, leucine, arginine, methionine, lysine, glutamine, and/or glutamate) at positions R257 and A258, R257 and G259, R257 and A260, R257 and L261, R257 and A262, A258 and G259, A258 and A260, A258 and L261, A258 and A262, G259 and A260, G259 and L261, G259 and A262, A260 and L261, A260 and A262, or L261 and A262 of SEQ ID NO:1 or an amino acid sequence that shares 90-99%, e.g., at least 90%, at least 95%, at least 96%, at least 97%, at least 98%, or at least 99% identity with SEQ ID NO:1.

In some embodiments, a RNA polymerase variant comprises an amino acid substitution (e.g., alanine, isoleucine, leucine, arginine, methionine, lysine, glutamine, and/or glutamate) at positions E42 and R257, E42 and A258, E42 and G259, E42 and A260, E42 and L261, E42 and A262, S43 and R257, S43 and A258, S43 and G259, S43 and A260, S43 and L261, S43 and A262, Y44 and R257, Y44 and A258, Y44 and G259, Y44 and A260, Y44 and L261, Y44 and A262, E45 and R257, E45 and A258, E45 and G259, E45 and A260, E45 and L261, E45 and A262, M46 and R257, M46 and A258, M46 and G259, M46 and A260, M46 and L261, M46 and A262, G47 and R257, G47 and A258, G47 and G259, G47 and A260, G47 and L261, or G47 and A262 of SEQ ID NO:1 or an amino acid sequence that shares 90-99%, e.g., at least 90%, at least 95%, at least 96%, at least 97%, at least 98%, or at least 99% identity with SEQ ID NO:1.

In some embodiments, a RNA polymerase comprise amino acid substitutions S43A and G47A of SEQ ID NO:1 or an amino acid sequence that shares 90-99%, e.g., at least 90%, at least 95%, at least 96%, at least 97%, at least 98%, or at least 99% identity with SEQ ID NO:1. In some embodiments, a RNA polymerase comprise amino acid substitutions S43A and R257A of SEQ ID NO:1 or an amino acid sequence that shares 90-99%, e.g., at least 90%, at least 95%, at least 96%, at least 97%, at least 98%, or at least 99% identity with SEQ ID NO:1. In some embodiments, a RNA polymerase comprise amino acid substitutions S43A and G259A of SEQ ID NO:1 or an amino acid sequence that shares 90-99%, e.g., at least 90%, at least 95%, at least 96%, at least 97%, at least 98%, or at least 99% identity with SEQ ID NO:1. In some embodiments, a RNA polymerase comprise amino acid substitutions G47A and R257A of SEQ ID NO:1 or an amino acid sequence that shares 90-99%, e.g., at least 90%, at least 95%, at least 96%, at least 97%, at least 98%, or at least 99% identity with SEQ ID NO:1. In some embodiments, a RNA polymerase comprise amino acid substitutions G47A and R257A of SEQ ID NO:1 or an amino acid sequence that shares 90-99%, e.g., at least 90%, at least 95%, at least 96%, at least 97%, at least 98%, or at least 99% identity with SEQ ID NO:1. In some embodiments, a RNA polymerase comprise amino acid substitutions R257A and G259A of SEQ ID NO:1 or an amino acid sequence that shares 90-99%, e.g., at least 90%, at least 95%, at least 96%, at least 97%, at least 98%, or at least 99% identity with SEQ ID NO:1. In some embodiments, a RNA polymerase comprise amino acid substitutions G47A and G259A of SEQ ID NO:1 or an amino acid sequence that shares 90-99%, e.g., at least 90%, at least 95%, at least 96%, at least 97%, at least 98%, or at least 99% identity with SEQ ID NO:1.

In some embodiments, a RNA polymerase variant comprises at least 3 (or at least 4 or at least 5) high-helix propensity amino acid (e.g., alanine, isoleucine, leucine, arginine, methionine, lysine, glutamine, and/or glutamate) substitutions at any one of amino acid positions 42-47 (E42, S43, Y44, E45, M46 and/or G47) and/or amino acid positions 257-262 (R257, A258, G259, A260, L261 and/or A262) of SEQ ID NO:1 or an amino acid sequence that shares 90-99%, e.g., at least 90%, at least 95%, at least 96%, at least 97%, at least 98%, or at least 99% identity with SEQ ID NO:1.

In some embodiments, a RNA polymerase variant comprises at least 1 (or at least 2 or at least 3 or at least 4 or at least 5) amino acid substitution(s) in SEQ ID NO:1 or an amino acid sequence that shares 90-99%, e.g., at least 90%, at least 95%, at least 96%, at least 97%, at least 98%, or at least 99% identity with SEQ ID NO:1, selected from the following: E42R, S43A, S43E, S43L, S43R, E45R, E45L, M46A, G47A, G47E, G47L, G47R, N165W, E167M, E167N, E168I, E168T, E168V, A181F, A181W, G184M, E187F, A255Q, A255K, A255I, A255Y, R257A, R257E, R257L, R257W, G259A, G259E, G259L, G259R, A260W, and A260R.

In some embodiments, a RNA polymerase comprise at least 2 high-helix propensity amino acid (e.g., alanine, isoleucine, leucine, arginine, methionine, lysine, glutamine, and/or glutamate) substitutions at any one of amino acid positions 42-47 (E42, S43, Y44, E45, M46 and/or G47) and/or amino acid positions 257-262 (R257, A258, G259, A260, L261 and/or A262) of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296.

For example, a RNA polymerase variant may comprise an amino acid substitution (e.g., alanine, isoleucine, leucine, arginine, methionine, lysine, glutamine, and/or glutamate) at positions E42 and S43, E42 and Y44, E42 and E45, E42 and M46, E42 and G47, S43 and Y44, S43 and E45, S43 and M46, S43 and G47, Y44 and E45, Y44 and M46, Y44 and G47, E45 and M46, E45 and G47, or M46 and G47 of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296.

In some embodiments, a RNA polymerase variant comprises an amino acid substitution (e.g., alanine, isoleucine, leucine, arginine, methionine, lysine, glutamine, and/or glutamate) at positions R257 and A258, R257 and G259, R257 and A260, R257 and L261, R257 and A262, A258 and G259, A258 and A260, A258 and L261, A258 and A262, G259 and A260, G259 and L261, G259 and A262, A260 and L261, A260 and A262, or L261 and A262 of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296.

In some embodiments, a RNA polymerase variant comprises an amino acid substitution (e.g., alanine, isoleucine, leucine, arginine, methionine, lysine, glutamine, and/or glutamate) at positions E42 and R257, E42 and A258, E42 and G259, E42 and A260, E42 and L261, E42 and A262, S43 and R257, S43 and A258, S43 and G259, S43 and A260, S43 and L261, S43 and A262, Y44 and R257, Y44 and A258, Y44 and G259, Y44 and A260, Y44 and L261, Y44 and A262, E45 and R257, E45 and A258, E45 and G259, E45 and A260, E45 and L261, E45 and A262, M46 and R257, M46 and A258, M46 and G259, M46 and A260, M46 and L261, M46 and A262, G47 and R257, G47 and A258, G47 and G259, G47 and A260, G47 and L261, or G47 and A262 of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296.

In some embodiments, a RNA polymerase comprises amino acid substitutions S43A and G47A of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296. In some embodiments, a RNA polymerase comprises amino acid substitutions S43A and R257A of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296. In some embodiments, a RNA polymerase comprises amino acid substitutions S43A and G259A of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296. In some embodiments, a RNA polymerase comprises amino acid substitutions G47A and R257A of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296. In some embodiments, a RNA polymerase comprises amino acid substitutions G47A and R257A of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296. In some embodiments, a RNA polymerase comprises amino acid substitutions R257A and G259A of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296. In some embodiments, a RNA polymerase comprises amino acid substitutions G47A and G259A of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296.

In some embodiments, a RNA polymerase variant comprises at least 3 (or at least 4 or at least 5) high-helix propensity amino acid (e.g., alanine, isoleucine, leucine, arginine, methionine, lysine, glutamine, and/or glutamate) substitutions at any one of amino acid positions 42-47 (E42, S43, Y44, E45, M46 and/or G47) and/or amino acid positions 257-262 (R257, A258, G259, A260, L261 and/or A262) of SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296.

In some embodiments, a RNA polymerase variant comprises at least 1 (or at least 2 or at least 3 or at least 4 or at least 5) amino acid substitution(s) in SEQ ID NO:99, 100, 294, 295, or 296 or an amino acid sequence that shares 90-99%, e.g., at least 90%, at least 95%, at least 96%, at least 97%, at least 98%, or at least 99% identity with SEQ ID NO:99, 100, 294, 295, or 296, selected from the following: E42R, S43A, S43E, S43L, S43R, E45R, E45L, M46A, G47A, G47E, G47L, G47R, N165W, E167M, E167N, E168I, E168T, E168V, A181F, A181W, G184M, E187F, R257A, R257E, R257L, R257W, G259A, G259E, G259L, G259R, A260W, and A260R.

In some embodiments, a RNA polymerase variant comprises at least 1 (or at least 2 or at least 3 or at least 4 or at least 5) amino acid substitution(s) selected from the following: E42R, S43A, S43E, S43L, S43R, E45R, E45L, M46A, G47A, G47E, G47L, G47R, N165W, E167M, E167N, E168I, E168T, E168V, A181F, A181W, G184M, E187F, R257A, R257E, R257L, R257W, G259A, G259E, G259L, G259R, A260W, and A260R, further comprises at least 1 (or at least 2 or at least 3 or at least 4 or at least 5) other amino acid substitution (e.g., an amino acid substitution not provided herein).

Thus, the present disclosure encompasses RNA polymerase variants that comprise at least 1 (or at least 2 or at least 3 or at least 4 or at least 5) amino acid substitution(s) selected from the following: E42R, S43A, S43E, S43L, S43R, E45R, E45L, M46A, G47A, G47E, G47L, G47R, N165W, E167M, E167N, E168I, E168T, E168V, A181F, A181W, G184M, E187F, A255K, A255Q, A255Y, A255I, R257A, R257E, R257L, R257W, G259A, G259E, G259L, G259R, A260W, and A260R and are at least 80%, at least 85%, at least 90%, at least 95%, at least 96%, at least 97%, at least 98%, or at least 99% identical to the amino acid sequence of SEQ ID NO: 1.

The term "identity" refers to a relationship between the sequences of two or more polypeptides (e.g. enzymes) or polynucleotides (nucleic acids), as determined by comparing the sequences. Identity also refers to the degree of sequence relatedness between or among sequences as determined by the number of matches between strings of two or more amino acid residues or nucleic acid residues. Identity measures the percent of identical matches between the smaller of two or more sequences with gap alignments (if any) addressed by a particular mathematical model or computer program (e.g., "algorithms"). Identity of related proteins or nucleic acids can be readily calculated by known methods. "Percent (%) identity" as it applies to polypeptide or polynucleotide sequences is defined as the percentage of residues (amino acid residues or nucleic acid residues) in the candidate amino acid or nucleic acid sequence that are identical with the residues in the amino acid sequence or nucleic acid sequence of a second sequence after aligning the sequences and introducing gaps, if necessary, to achieve the maximum percent identity. Methods and computer programs for the alignment are well known in the art. It is understood that identity depends on a calculation of percent identity but may differ in value due to gaps and penalties introduced in the calculation. Generally, variants of a particular polynucleotide or polypeptide (e.g., antigen) have at least 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, et al (1997), "Gapped BLAST and PSI-BLAST: a new generation of protein database search programs", *Nucleic Acids Res.* 25:3389-3402). Another popular local alignment technique is based on the Smith-Waterman algorithm (Smith, T. F. & Waterman, M. S. (1981) "Identification of common molecular subsequences." *J. Mol. Biol.* 147:195-197). A general global alignment technique based on dynamic programming is the Needleman-Wunsch algorithm (Needleman, S. B. & Wunsch, C. D. (1970) "A general method applicable to the search for similarities in the amino acid sequences of two proteins." *J. Mol. Biol.* 48:443-453). More recently a Fast Optimal Global Sequence Alignment Algorithm (FOGSAA) has been developed that purportedly produces global alignment of nucleotide and protein sequences faster than other optimal global alignment methods, including the Needleman-Wunsch algorithm.

Trinucleotide Caps

Also provided herein are co-transcriptional capping methods for ribonucleic acid (RNA) synthesis. That is, RNA is produced in a "one-pot" reaction, without the need for a separate capping reaction. Thus, the methods, in some embodiments, comprise reacting a polynucleotide template with a T7 RNA polymerase variant, nucleoside triphosphates, and a cap analog under in vitro transcription reaction conditions to produce RNA transcript.

A cap analog may be, for example, a dinucleotide cap, a trinucleotide cap, or a tetranucleotide cap. In some embodiments, a cap analog is a dinucleotide cap. In some embodiments, a cap analog is a trinucleotide cap. In some embodiments, a cap analog is a tetranucleotide cap.

A trinucleotide cap, in some embodiments, comprises a compound of formula (I)

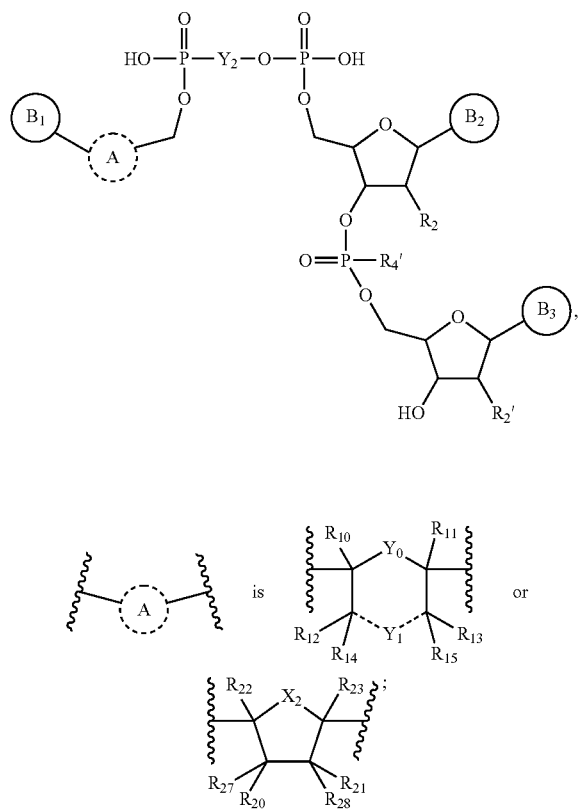

ring $B_1$ is a modified or unmodified Guanine;
ring $B_2$ and ring $B_3$ each independently is a nucleobase or a modified nucleobase;
$X_2$ is O, $S(O)_p$, $NR_{24}$ or $CR_{25}R_{26}$ in which p is 0, 1, or 2;
$Y_0$ is O or $CR_6R_7$;
$Y_1$ is O, $S(O)_n$, $CR_6R_7$, or $NR_8$, in which n is 0, 1, or 2;
each --- is a single bond or absent, wherein when each --- is a single bond, $Y_1$ is O, $S(O)_n$, $CR_6R_7$, or $NR_8$; and when each --- is absent, $Y_1$ is void;
$Y_2$ is $(OP(O)R_4)_m$ in which m is 0, 1, or 2, or —O—$(CR_{40}R_{41})u$-$Q_0$-$(CR_{42}R_{43})v$-, in which $Q_0$ is a bond, O, $S(O)_r$, $NR_{44}$, or $CR_{45}R_{46}$, r is 0, 1, or 2, and each of u and v independently is 1, 2, 3 or 4;
each $R_2$ and $R_2'$ independently is halo, LNA, or $OR_3$;
each $R_3$ independently is H, $C_1$-$C_6$ alkyl, $C_2$-$C_6$ alkenyl, or $C_2$-$C_6$ alkynyl and $R_3$, when being $C_1$-$C_6$ alkyl, $C_2$-$C_6$ alkenyl, or $C_2$-$C_6$ alkynyl, is optionally substituted with one or more of halo, OH and $C_1$-$C_6$ alkoxyl that is optionally substituted with one or more OH or OC(O)—$C_1$-$C_6$ alkyl;
each $R_4$ and $R_4'$ independently is H, halo, $C_1$-$C_6$ alkyl, OH, SH, SeH, or $BH_3^-$;
each of $R_6$, $R_7$, and $R_8$, independently, is -$Q_1$-$T_1$, in which $Q_1$ is a bond or $C_1$-$C_3$ alkyl linker optionally substituted with one or more of halo, cyano, OH and $C_1$-$C_6$ alkoxy, and $T_1$ is H, halo, OH, COOH, cyano, or $R_{s1}$, in which $R_{s1}$ is $C_1$-$C_3$ alkyl, $C_2$-$C_6$ alkenyl, $C_2$-$C_6$ alkynyl, $C_1$-$C_6$ alkoxyl, C(O)O—$C_1$-$C_6$ alkyl, $C_3$-$C_8$ cycloalkyl, $C_6$-$C_{10}$ aryl, $NR_{31}R_{32}$, $(NR_{31}R_{32}R_{33})^+$, 4 to 12-membered heterocycloalkyl, or 5- or 6-membered heteroaryl, and $R_{s1}$ is optionally substituted with one or more substituents selected from the group consisting of halo, OH, oxo, $C_1$-$C_6$ alkyl, COOH, C(O)O—$C_1$-$C_6$ alkyl, cyano, $C_1$-$C_6$ alkoxyl, $NR_{31}R_{32}$, $(NR_{31}R_{32}R_{33})^+$, $C_3$-$C_8$ cycloalkyl, $C_6$-$C_{10}$ aryl, 4 to 12-membered heterocycloalkyl, and 5- or 6-membered heteroaryl;
each of $R_{10}$, $R_{11}$, $R_{12}$, $R_{13}$ $R_{14}$, and $R_{15}$, independently, is -$Q_2$-$T_2$, in which $Q_2$ is a bond or $C_1$-$C_3$ alkyl linker optionally substituted with one or more of halo, cyano, OH and $C_1$-$C_6$ alkoxy, and $T_2$ is H, halo, OH, $NH_2$, cyano, $NO_2$, $N_3$, $R_{s2}$, or $OR_{s2}$, in which $R_{s2}$ is $C_1$-$C_6$ alkyl, $C_2$-$C_6$ alkenyl, $C_2$-$C_6$ alkynyl, $C_3$-$C_8$ cycloalkyl, $C_6$-$C_{10}$ aryl, NHC(O)—$C_1$-$C_6$ alkyl, $NR_{31}R_{32}$, $(NR_{31}R_{32}R_{33})^+$, 4 to 12-membered heterocycloalkyl, or 5- or 6-membered heteroaryl, and $R_{s2}$ is optionally substituted with one or more substituents selected from the group consisting of halo, OH, oxo, $C_1$-$C_6$ alkyl, COOH, C(O)O—$C_1$-$C_6$ alkyl, cyano, $C_1$-$C_6$ alkoxyl, $NR_{31}R_{32}$, $(NR_{31}R_{32}R_{33})^+$, $C_3$-$C_8$ cycloalkyl, $C_6$-$C_{10}$ aryl, 4 to 12-membered heterocycloalkyl, and 5- or 6-membered heteroaryl; or alternatively $R_{12}$ together with $R_{14}$ is oxo, or $R_{13}$ together with $R_{15}$ is oxo,
each of $R_{20}$, $R_{21}$, $R_{22}$, and $R_{23}$ independently is -$Q_3$-$T_3$, in which $Q_3$ is a bond or $C_1$-$C_3$ alkyl linker optionally substituted with one or more of halo, cyano, OH and $C_1$-$C_6$ alkoxy, and $T_3$ is H, halo, OH, $NH_2$, cyano, $NO_2$, $N_3$, $R_{S3}$, or $OR_{S3}$, in which $R_{S3}$ is $C_1$-$C_6$ alkyl, $C_2$-$C_6$ alkenyl, $C_2$-$C_6$ alkynyl, $C_3$-$C_8$ cycloalkyl, $C_6$-$C_{10}$ aryl, NHC(O)—$C_1$-$C_6$ alkyl, mono-$C_1$-$C_6$ alkylamino, di-$C_1$-$C_6$ alkylamino, 4 to 12-membered heterocycloalkyl, or 5- or 6-membered heteroaryl, and $R_{S3}$ is optionally substituted with one or more substituents selected from the group consisting of halo, OH, oxo, $C_1$-$C_6$ alkyl, COOH, C(O)O—$C_1$-$C_6$ alkyl, cyano, $C_1$-$C_6$ alkoxyl, amino, mono-$C_1$-$C_6$ alkylamino, di-$C_1$-$C_6$ alkylamino, $C_3$-$C_8$ cycloalkyl, $C_6$-$C_{10}$ aryl, 4 to 12-membered heterocycloalkyl, and 5- or 6-membered heteroaryl;
each of $R_{24}$, $R_{25}$, and $R_{26}$ independently is H or $C_1$-$C_6$ alkyl;
each of $R_{27}$ and $R_{28}$ independently is H or $OR_{29}$; or $R_{27}$ and $R_{28}$ together form O—$R_{30}$—O; each $R_{29}$ independently is H, $C_1$-$C_6$ alkyl, $C_2$-$C_6$ alkenyl, or $C_2$-$C_6$ alkynyl and $R_{29}$, when being $C_1$-$C_6$ alkyl, $C_2$-$C_6$ alkenyl, or $C_2$-$C_6$ alkynyl, is optionally substituted with one or more of halo, OH and $C_1$-$C_6$ alkoxyl that is optionally substituted with one or more OH or OC(O)—$C_1$-$C_6$ alkyl;

$R_{30}$ is $C_1$-$C_6$ alkylene optionally substituted with one or more of halo, OH and $C_1$-$C_6$ alkoxyl;

each of $R_{31}$, $R_{32}$, and $R_{33}$, independently is H, $C_1$-$C_6$ alkyl, $C_3$-$C_8$ cycloalkyl, $C_6$-$C_{10}$ aryl, 4 to 12-membered heterocycloalkyl, or 5- or 6-membered heteroaryl;

each of $R_{40}$, $R_{41}$, $R_{42}$, and $R_{43}$ independently is H, halo, OH, cyano, N3, OP(O)$R_{47}R_{48}$, or $C_1$-$C_6$ alkyl optionally substituted with one or more OP(O)$R_{47}R_{48}$, or one $R_{41}$ and one $R_{43}$, together with the carbon atoms to which they are attached and $Q_0$, form $C_4$-$C_{10}$ cycloalkyl, 4- to 14-membered heterocycloalkyl, $C_6$-$C_{10}$ aryl, or 5- to 14-membered heteroaryl, and each of the cycloalkyl, heterocycloalkyl, phenyl, or 5- to 6-membered heteroaryl is optionally substituted with one or more of OH, halo, cyano, N3, oxo, OP(O)$R_{47}R_{48}$, $C_1$-$C_6$ alkyl, $C_1$-$C_6$ haloalkyl, COOH, C(O)O—$C_1$-$C_6$ alkyl, $C_1$-$C_6$ alkoxyl, $C_1$-$C_6$ haloalkoxyl, amino, mono-$C_1$-$C_6$ alkylamino, and di-$C_1$-$C_6$ alkylamino;

$R_{44}$ is H, $C_1$-$C_6$ alkyl, or an amine protecting group;

each of $R_{45}$ and $R_{46}$ independently is H, OP(O)$R_{47}R_{48}$, or $C_1$-$C_6$ alkyl optionally substituted with one or more OP(O)$R_{47}R_{48}$, and each of $R_{47}$ and $R_{48}$, independently is H, halo, $C_1$-$C_6$ alkyl, OH, SH, SeH, or $BH_3^-$.

It should be understood that a cap analog, as provided herein, may include any of the cap analogs described in international publication WO 2017/066797, published on 20 Apr. 2017, incorporated by reference herein in its entirety.

In some embodiments, the $B_2$ middle position can be a non-ribose molecule, such as arabinose.

In some embodiments $R_2$ is ethyl-based.

Thus, in some embodiments, a trinucleotide cap comprises the following structure:

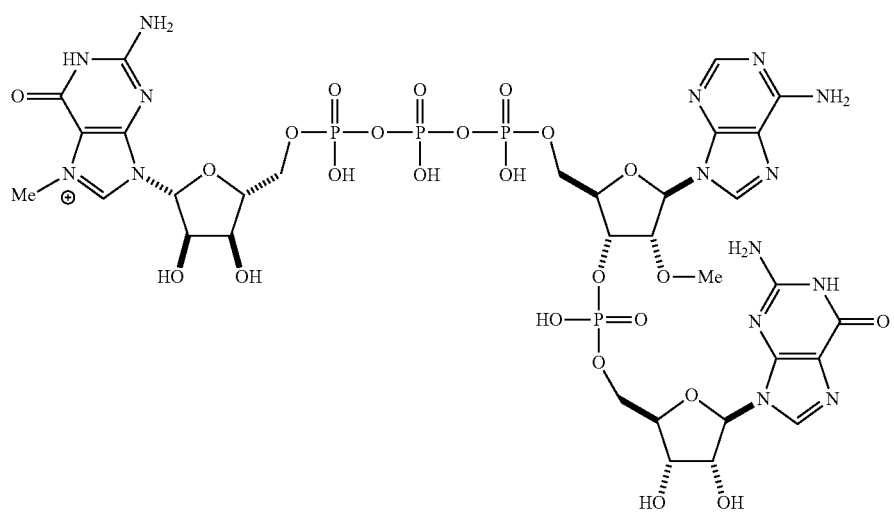

(II)

In other embodiments, a trinucleotide cap comprises the following structure:

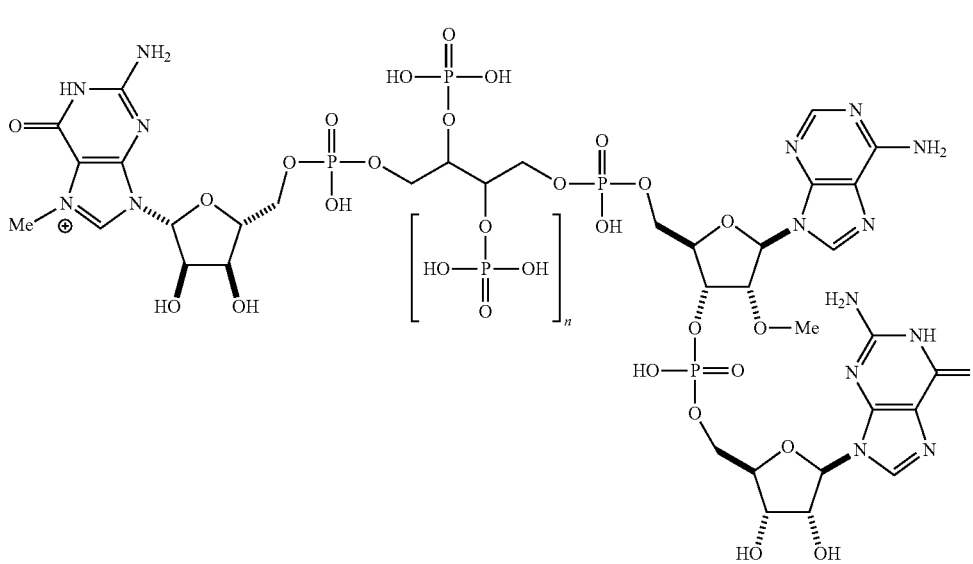

(III)

In yet other embodiments, a trinucleotide cap comprises the following structure:

(IV)

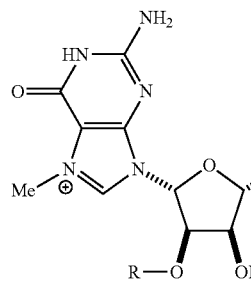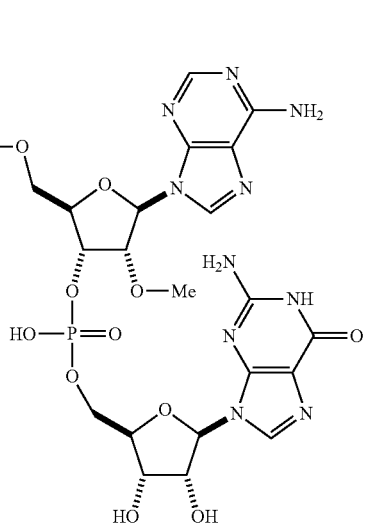

In still other embodiments, a trinucleotide cap comprises the following structure:

(V)

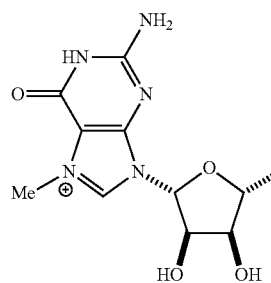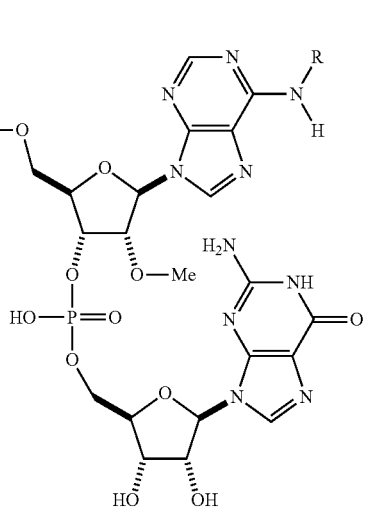

A trinucleotide cap, in some embodiments, comprises a sequence selected from the following sequences: GAA, GAC, GAG, GAU, GCA, GCC, GCG, GCU, GGA, GGC, GGG, GGU, GUA, GUC, GUG, and GUU. In some embodiments, a trinucleotide cap comprises GAA. In some embodiments, a trinucleotide cap comprises GAC. In some embodiments, a trinucleotide cap comprises GAG. In some embodiments, a trinucleotide cap comprises GAU. In some embodiments, a trinucleotide cap comprises GCA. In some embodiments, a trinucleotide cap comprises GCC. In some embodiments, a trinucleotide cap comprises GCG. In some embodiments, a trinucleotide cap comprises GCU. In some embodiments, a trinucleotide cap comprises GGA. In some embodiments, a trinucleotide cap comprises GGC. In some embodiments, a trinucleotide cap comprises GGG. In some embodiments, a trinucleotide cap comprises GGU. In some embodiments, a trinucleotide cap comprises GUA. In some embodiments, a trinucleotide cap comprises GUC. In some embodiments, a trinucleotide cap comprises GUG. In some embodiments, a trinucleotide cap comprises GUU.

In some embodiments, a trinucleotide cap comprises a sequence selected from the following sequences: $m^7GpppApA$, $m^7GpppApC$, $m^7GpppApG$, $m^7GpppApU$, $m^7GpppCpA$, $m^7GpppCpC$, $m^7GpppCpG$, $m^7GpppCpU$, $m^7GpppGpA$, $m^7GpppGpC$, $m^7GpppGpG$, $m^7GpppGpU$, $m^7GpppUpA$, $m^7GpppUpC$, $m^7GpppUpG$, and $m^7GpppUpU$.

In some embodiments, a trinucleotide cap comprises $m^7GpppApA$. In some embodiments, a trinucleotide cap comprises $m^7GpppApC$. In some embodiments, a trinucleotide cap comprises $m^7GpppApG$. In some embodiments, a trinucleotide cap comprises $m^7GpppApU$. In some embodiments, a trinucleotide cap comprises $m^7GpppCpA$. In some embodiments, a trinucleotide cap comprises $m^7GpppCpC$. In some embodiments, a trinucleotide cap comprises $m^7GpppCpG$. In some embodiments, a trinucleotide cap comprises m⁷GpppCpU. In some embodiments, a trinucleotide cap comprises m⁷GpppGpA. In some embodiments, a trinucleotide cap comprises m⁷GpppGpC. In some embodiments, a trinucleotide cap comprises m⁷GpppGpG. In some embodiments, a trinucleotide cap comprises m⁷GpppGpU. In some embodiments, a trinucleotide cap comprises m⁷GpppUpA. In some embodiments, a trinucleotide cap comprises m⁷GpppUpC. In some embodiments, a trinucleotide cap comprises m⁷GpppUpG. In some embodiments, a trinucleotide cap comprises m⁷GpppUpU.

A trinucleotide cap, in some embodiments, comprises a sequence selected from the following sequences: $m^7G_{3'OMe}pppApA$, $m^7G_{3'OMe}pppApC$, $m^7G_{3'OMe}pppApG$, $m^7G_{3'OMe}pppApU$, $m^7G_{3'OMe}pppCpA$, $m^7G_{3'OMe}pppCpC$, $m^7G_{3'OMe}pppCpG$, $m^7G_{3'OMe}pppCpU$, $m^7G_{3'OMe}pppGpA$, $m^7G_{3'OMe}pppGpC$, $m^7G_{3'OMe}pppGpG$, $m^7G_{3'OMe}pppGpU$, $m^7G_{3'OMe}pppUpA$, $m^7G_{3'OMe}pppUpC$, $m^7G_{3'OMe}pppUpG$, and $m^7G_{3'OMe}pppUpU$.

In some embodiments, a trinucleotide cap comprises $m^7G_{3'OMe}pppApA$. In some embodiments, a trinucleotide cap comprises $m^7G_{3'OMe}pppApC$. In some embodiments, a trinucleotide cap comprises $m^7G_{3'OMe}pppApG$. In some embodiments, a trinucleotide cap comprises $m^7G_{3'OMe}pppApU$. In some embodiments, a trinucleotide cap comprises $m^7G_{3'OMe}pppCpA$. In some embodiments, a trinucleotide cap comprises $m^7G_{3'OMe}pppCpC$. In some embodiments, a trinucleotide cap comprises $m^7G_{3'OMe}pppCpG$. In some embodiments, a trinucleotide cap comprises $m^7G_{3'OMe}pppCpU$. In some embodiments, a trinucleotide cap comprises $m^7G_{3'OMe}pppGpA$. In some embodiments, a trinucleotide cap comprises $m^7G_{3'OMe}pppGpC$. In some embodiments, a trinucleotide cap comprises $m^7G_{3'OMe}pppGpG$. In some embodiments, a trinucleotide cap comprises $m^7G_{3'OMe}pppGpU$. In some embodiments, a trinucleotide cap comprises $m^7G_{3'OMe}pppUpA$. In some embodiments, a trinucleotide cap comprises $m^7G_{3'OMe}pppUpC$. In some embodiments, a trinucleotide cap comprises $m^7G_{3'OMe}pppUpG$. In some embodiments, a trinucleotide cap comprises $m^7G_{3'OMe}pppUpU$.

A trinucleotide cap, in other embodiments, comprises a sequence selected from the following sequences: $m^7G_{3'OMe}pppA_{2'OMe}pA$, $m^7G_{3'OMe}pppA_{2'OMe}pC$, $m^7G_{3'OMe}pppA_{2'OMe}pG$, $m^7G_{3'OMe}pppA_{2'OMe}pU$, $m^7G_{3'OMe}pppC_{2'OMe}pG$, $m^7G_{3'OMe}pppC_{2'OMe}pC$, $m^7G_{3'OMe}pppC_{2'OMe}pG$, $m^7G_{3'OMe}pppC_{2'OMe}pU$, $m^7G_{3'OMe}pppG_{2'OMe}pA$, $M7G_{3'OMe}pppG_{2'OMe}pC$, $m^7G_{3'OMe}pppG_{2'OMe}pG$, $m^7G_{3'OMe}pppG_{2'OMe}pU$, $m^7G_{3'OMe}pppU_{2'OMe}pA$, $m^7G_{3'OMe}pppU_{2'OMe}pC$, $m^7G_{3'OMe}pppU_{2'OMe}pG$, and $m^7G_{3'OMe}pppU_{2'OMe}pU$.

In some embodiments, a trinucleotide cap comprises $m^7G_{3'OMe}pppA_{2'OMe}pA$. In some embodiments, a trinucleotide cap comprises $m^7G_{3'OMe}pppA_{2'OMe}pC$. In some embodiments, a trinucleotide cap comprises $m^7G_{3'OMe}pppA_{2'OMe}pG$. In some embodiments, a trinucleotide cap comprises $m^7G_{3'OMe}pppA_{2'OMe}pU$. In some embodiments, a trinucleotide cap comprises $m^7G_{3'OMe}pppC_{2'OMe}pA$. In some embodiments, a trinucleotide cap comprises $m^7G_{3'OMe}pppC_{2'OMe}pC$. In some embodiments, a trinucleotide cap comprises $m^7G_{3'OMe}pppC_{2'OMe}pG$. In some embodiments, a trinucleotide cap comprises $m^7G_{3'OMe}pppC_{2'OMe}pU$. In some embodiments, a trinucleotide cap comprises $m^7G_{3'OMe}pppG_{2'OMe}pA$. In some embodiments, a trinucleotide cap comprises $m^7G_{3'OMe}pppG_{2'OMe}pC$. In some embodiments, a trinucleotide cap comprises $m^7G_{3'OMe}pppG_{2'OMe}pG$. In some embodiments, a trinucleotide cap comprises $m^7G_{3'OMe}pppG_{2'OMe}pU$. In some embodiments, a trinucleotide cap comprises $m^7G_{3'OMe}pppU_{2'OMe}pA$. In some embodiments, a trinucleotide cap comprises $m^7G_{3'OMe}pppU_{2'OMe}pC$. In some embodiments, a trinucleotide cap comprises $m^7G_{3'OMe}pppU_{2'OMe}pG$. In some embodiments, a trinucleotide cap comprises $m^7G_{3'OMe}pppU_{2'OMe}pU$.

A trinucleotide cap, in still other embodiments, comprises a sequence selected from the following sequences: $m^7GpppA_{2'OMe}pA$, $m^7GpppA_{2'OMe}pC$, $m^7GpppA_{2'OMe}pG$, $m^7GpppA_{2'OMe}pU$, $m^7GpppC_{2'OMe}pA$, $m^7GpppC_{2'OMe}pC$, $m^7GpppC_{2'OMe}pG$, $m^7GpppC_{2'OMe}pU$, $m^7GpppG_{2'OMe}pA$, $m^7GpppG_{2'OMe}pC$, $m^7GpppG_{2'OMe}pG$, $m^7GpppG_{2'OMe}pU$, $m^7GpppU_{2'OMe}pA$, $m^7GpppU_{2'OMe}pC$, $m^7GpppU_{2'OMe}pG$, and $m^7GpppU_{2'OMe}pU$.

In some embodiments, a trinucleotide cap comprises $m^7GpppA_{2'OMe}pA$. In some embodiments, a trinucleotide cap comprises $m^7GpppA_{2'OMe}pC$. In some embodiments, a trinucleotide cap comprises $m^7GpppA_{2'OMe}pG$. In some embodiments, a trinucleotide cap comprises $m^7GpppA_{2'OMe}pU$. In some embodiments, a trinucleotide cap comprises $m^7GpppC_{2'OMe}pA$. In some embodiments, a trinucleotide cap comprises $m^7GpppC_{2'OMe}pC$. In some embodiments, a trinucleotide cap comprises $m^7GpppC_{2'OMe}pG$. In some embodiments, a trinucleotide cap comprises $m^7GpppC_{2'OMe}pU$. In some embodiments, a trinucleotide cap comprises $m^7GpppG_{2'OMe}pA$. In some embodiments, a trinucleotide cap comprises $m^7GpppG_{2'OMe}pC$. In some embodiments, a trinucleotide cap comprises $m^7GpppG_{2'OMe}pG$. In some embodiments, a trinucleotide cap comprises $m^7GpppG_{2'OMe}pU$. In some embodiments, a trinucleotide cap comprises $m^7GpppU_{2'OMe}pA$. In some embodiments, a trinucleotide cap comprises $m^7GpppU_{2'OMe}pC$. In some embodiments, a trinucleotide cap comprises $m^7GpppU_{2'OMe}pG$. In some embodiments, a trinucleotide cap comprises $m^7GpppU_{2'OMe}pU$.

In some embodiments, a trinucleotide cap comprises GAG. In some embodiments, a trinucleotide cap comprises GCG. In some embodiments, a trinucleotide cap comprises GUG. In some embodiments, a trinucleotide cap comprises GGG.

In Vitro Transcription Methods

Some aspects of the present disclosure provide methods of producing (synthesizing) a RNA transcript (e.g., mRNA transcript) comprising contacting a DNA template with a RNA polymerase (e.g., a T7 RNA polymerase such as a T7 RNA polymerase variant) under conditions that result in the production of RNA transcript.

In some embodiments, the methods comprise contacting a DNA template with a T7 RNA polymerase (e.g., SEQ ID NO:1, 99, or 100) variant having a S43A substitution (e.g., a S43A T7 RNAP variant or a S43A* T7 RNAP variant) under conditions that result in the production of RNA transcript. In other embodiments, the methods comprise contacting a DNA template with a T7 RNA polymerase (e.g., SEQ ID NO:1, 99, or 100) variant having a G47A substitution (e.g., a G47A T7 RNAP variant or a G47A* T7 RNAP variant) under conditions that result in the production of RNA transcript. In yet other embodiments, the methods comprise contacting a DNA template with a T7 RNA polymerase (e.g., SEQ ID NO:1, 99, or 100) variant having a R257A substitution (e.g., a R257A T7 RNAP variant or a R257A* T7 RNAP variant) under conditions that result in the production of RNA transcript. In still other embodiments, the methods comprise contacting a DNA template with a T7 RNA polymerase (e.g., SEQ ID NO:1, 99, or 100)

variant having a G259A substitution (e.g., a G259A T7 RNAP variant or a G259A* T7 RNAP variant) under conditions that result in the production of RNA transcript.

In some embodiments, the methods comprise contacting a DNA template with a T7 RNA polymerase variant that comprises an (at least one) additional C terminal amino acid (e.g., Gly, Ala, GlyGly, AlaAla, GlyAla, or AlaGly).

In some embodiments, the methods comprise contacting a DNA template with a T7 RNA polymerase variant that comprises a E42R, S43A, S43E, S43L, S43R, E45R, E45L, M46A, G47A, G47E, G47L, G47R, N165W, E167M, E167N, E168I, E168T, E168V, A181F, A181W, G184M, E187F, A255Q, A255K, A255I, A255Y, R257A, R257E, R257L, R257W, G259A, G259E, G259L, G259R, A260W, or A260R substitution, or any combination of two or more of the foregoing substitutions and optionally an additional C terminal amino acid (e.g., Gly, Ala, GlyGly, AlaAla, GlyAla, or AlaGly).

In some aspects, the present disclosure provides methods of performing an IVT reaction, comprising contacting a DNA template with the RNA polymerase (e.g., a T7 RNA polymerase, such as a T7 RNA polymerase variant) in the presence of nucleoside triphosphates and buffer under conditions that result in the production of RNA transcripts.

Other aspects of the present disclosure provide co-transcriptional capping methods that comprise reacting a polynucleotide template with a T7 RNA polymerase variant, nucleoside triphosphates, and a cap analog under in vitro transcription reaction conditions to produce RNA transcript.

In some embodiments, a co-transcriptional capping method for RNA synthesis comprises reacting a polynucleotide template with (a) a T7 RNA polymerase variant comprising at least one amino acid substitution, relative to wild-type RNA polymerase, that causes at least one loop structure of the RNA polymerase variant to undergo a conformational change to a helix structure as the RNA polymerase variant transitions from an initiation complex to an elongation complex, (b) nucleoside triphosphates, and (c) a trinucleotide cap comprising sequence $GpppA_{2'Ome}pG$, under in vitro transcription reaction conditions to produce RNA transcript, wherein the polynucleotide template includes a 2'-deoxythymidine residue at template position +1.

IVT conditions typically require a purified linear DNA template containing a promoter, nucleoside triphosphates, a buffer system that includes dithiothreitol (DTT) and magnesium ions, and a RNA polymerase. The exact conditions used in the transcription reaction depend on the amount of RNA needed for a specific application. Typical IVT reactions are performed by incubating a DNA template with a RNA polymerase and nucleoside triphosphates, including GTP, ATP, CTP, and UTP (or nucleotide analogs) in a transcription buffer. A RNA transcript having a 5' terminal guanosine triphosphate is produced from this reaction.

A deoxyribonucleic acid (DNA) is simply a nucleic acid template for RNA polymerase. A DNA template may include a polynucleotide encoding a polypeptide of interest (e.g., an antigenic polypeptide). A DNA template, in some embodiments, includes a RNA polymerase promoter (e.g., a T7 RNA polymerase promoter) located 5' from and operably linked to polynucleotide encoding a polypeptide of interest. A DNA template may also include a nucleotide sequence encoding a polyadenylation (polyA) tail located at the 3' end of the gene of interest.

Polypeptides of interest include, but are not limited to, biologics, antibodies, antigens (vaccines), and therapeutic proteins. The term "protein" encompasses peptides.

A RNA transcript, in some embodiments, is the product of an IVT reaction. A RNA transcript, in some embodiments, is a messenger RNA (mRNA) that includes a nucleotide sequence encoding a polypeptide of interest linked to a polyA tail. In some embodiments, the mRNA is modified mRNA (mmRNA), which includes at least one modified nucleotide.

A nucleotide includes a nitrogenous base, a five-carbon sugar (ribose or deoxyribose), and at least one phosphate group. Nucleotides include nucleoside monophosphates, nucleoside diphosphates, and nucleoside triphosphates. A nucleoside monophosphate (NMP) includes a nucleobase linked to a ribose and a single phosphate; a nucleoside diphosphate (NDP) includes a nucleobase linked to a ribose and two phosphates; and a nucleoside triphosphate (NTP) includes a nucleobase linked to a ribose and three phosphates. Nucleotide analogs are compounds that have the general structure of a nucleotide or are structurally similar to a nucleotide. Nucleotide analogs, for example, include an analog of the nucleobase, an analog of the sugar and/or an analog of the phosphate group(s) of a nucleotide.

A nucleoside includes a nitrogenous base and a 5-carbon sugar. Thus, a nucleoside plus a phosphate group yields a nucleotide. Nucleoside analogs are compounds that have the general structure of a nucleoside or are structurally similar to a nucleoside. Nucleoside analogs, for example, include an analog of the nucleobase and/or an analog of the sugar of a nucleoside.

It should be understood that the term "nucleotide" includes naturally-occurring nucleotides, synthetic nucleotides and modified nucleotides, unless indicated otherwise. Examples of naturally-occurring nucleotides used for the production of RNA, e.g., in an IVT reaction, as provided herein include adenosine triphosphate (ATP), guanosine triphosphate (GTP), cytidine triphosphate (CTP), uridine triphosphate (UTP), and 5-methyluridine triphosphate ($m^5UTP$). In some embodiments, adenosine diphosphate (ADP), guanosine diphosphate (GDP), cytidine diphosphate (CDP), and/or uridine diphosphate (UDP) are used.

Examples of nucleotide analogs include, but are not limited to, antiviral nucleotide analogs, phosphate analogs (soluble or immobilized, hydrolyzable or non-hydrolyzable), dinucleotide, trinucleotide, tetranucleotide, e.g., a cap analog, or a precursor/substrate for enzymatic capping (vaccinia or ligase), a nucleotide labeled with a functional group to facilitate ligation/conjugation of cap or 5' moiety (IRES), a nucleotide labeled with a 5' PO4 to facilitate ligation of cap or 5' moiety, or a nucleotide labeled with a functional group/protecting group that can be chemically or enzymatically cleaved. Examples of antiviral nucleotide/nucleoside analogs include, but are not limited to, Ganciclovir, Entecavir, Telbivudine, Vidarabine and Cidofovir.

Modified nucleotides may include modified nucleobases. For example, a RNA transcript (e.g., mRNA transcript) of the present disclosure may include a modified nucleobase selected from pseudouridine (ψ), 1-methylpseudouridine (m1ψ), 1-ethylpseudouridine, 2-thiouridine, 4'-thiouridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methoxyuridine (mo5U) and 2'-O-methyl uridine. In some embodiments, a RNA transcript (e.g., mRNA transcript) includes a combination of at least two (e.g., 2, 3, 4 or more) of the foregoing modified nucleobases.

The nucleoside triphosphates (NTPs) as provided herein may comprise unmodified or modified ATP, modified or unmodified UTP, modified or unmodified GTP, and/or modified or unmodified CTP. In some embodiments, NTPs of an IVT reaction comprise unmodified ATP. In some embodiments, NTPs of an IVT reaction comprise modified ATP. In some embodiments, NTPs of an IVT reaction comprise unmodified UTP. In some embodiments, NTPs of an IVT reaction comprise modified UTP. In some embodiments, NTPs of an IVT reaction comprise unmodified GTP. In some embodiments, NTPs of an IVT reaction comprise modified GTP. In some embodiments, NTPs of an IVT reaction comprise unmodified CTP. In some embodiments, NTPs of an IVT reaction comprise modified CTP.

The concentration of nucleoside triphosphates and cap analog present in an IVT reaction may vary. In some embodiments, NTPs and cap analog are present in the reaction at equimolar concentrations. In some embodiments, the molar ratio of cap analog (e.g., trinucleotide cap) to nucleoside triphosphates in the reaction is greater than 1:1. For example, the molar ratio of cap analog to nucleoside triphosphates in the reaction may be 2:1, 3:1, 4:1, 5:1, 6:1, 7:1, 8:1, 9:1, 10:1, 15:1, 20:1, 25:1, 50:1, or 100:1. In some embodiments, the molar ratio of cap analog (e.g., trinucleotide cap) to nucleoside triphosphates in the reaction is less than 1:1. For example, the molar ratio of cap analog (e.g., trinucleotide cap) to nucleoside triphosphates in the reaction may be 1:2, 1:3, 1:4, 1:5, 1:6, 1:7, 1:8, 1:9, 1:10, 1:15, 1:20, 1:25, 1:50, or 1:100.

The composition of NTPs in an IVT reaction may also vary. For example, ATP may be used in excess of GTP, CTP and UTP. As a non-limiting example, an IVT reaction may include 7.5 millimolar GTP, 7.5 millimolar CTP, 7.5 millimolar UTP, and 3.75 millimolar ATP. The same IVT reaction may include 3.75 millimolar cap analog (e.g., trinucleotide cap). In some embodiments, the molar ratio of G:C:U:A:cap is 1:1:1:0.5:0.5. In some embodiments, the molar ratio of G:C:U:A:cap is 1:1:0.5:1:0.5. In some embodiments, the molar ratio of G:C:U:A:cap is 1:0.5:1:1:0.5. In some embodiments, the molar ratio of G:C:U:A:cap is 0.5:1:1:1:0.5.

In some embodiments, a RNA transcript (e.g., mRNA transcript) includes a modified nucleobase selected from pseudouridine ($\psi$), 1-methylpseudouridine ($m^1\psi$), 5-methoxyuridine ($mo^5U$), 5-methylcytidine ($m^5C$), α-thio-guanosine and α-thio-adenosine. In some embodiments, a RNA transcript (e.g., mRNA transcript) includes a combination of at least two (e.g., 2, 3, 4 or more) of the foregoing modified nucleobases.

In some embodiments, a RNA transcript (e.g., mRNA transcript) includes pseudouridine ($\psi$). In some embodiments, a RNA transcript (e.g., mRNA transcript) includes 1-methylpseudouridine ($m^1\psi$). In some embodiments, a RNA transcript (e.g., mRNA transcript) includes 5-methoxyuridine ($mo^5U$). In some embodiments, a RNA transcript (e.g., mRNA transcript) includes 5-methylcytidine ($m^5C$). In some embodiments, a RNA transcript (e.g., mRNA transcript) includes α-thio-guanosine. In some embodiments, a RNA transcript (e.g., mRNA transcript) includes α-thio-adenosine.

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 1-methylpseudouridine ($m^1\psi$), meaning that all uridine residues in the mRNA sequence are replaced with 1-methylpseudouridine ($m^1\psi$). Similarly, a polynucleotide can be uniformly modified for any type of nucleoside residue present in the sequence by replacement with a modified residue such as any of those set forth above. Alternatively, the polynucleotide (e.g., RNA polynucleotide, such as mRNA polynucleotide) may not be uniformly modified (e.g., partially modified, part of the sequence is modified). Each possibility represents a separate embodiment of the present invention.

In some embodiments, the buffer system contains tris. The concentration of tris used in an IVT reaction, for example, may be at least 10 mM, at least 20 mM, at least 30 mM, at least 40 mM, at least 50 mM, at least 60 mM, at least 70 mM, at least 80 mM, at least 90 mM, at least 100 mM or at least 110 mM phosphate. In some embodiments, the concentration of phosphate is 20-60 mM or 10-100 mM.

In some embodiments, the buffer system contains dithiothreitol (DTT). The concentration of DTT used in an IVT reaction, for example, may be at least 1 mM, at least 5 mM, or at least 50 mM. In some embodiments, the concentration of DTT used in an IVT reaction is 1-50 mM or 5-50 mM. In some embodiments, the concentration of DTT used in an IVT reaction is 5 mM.

In some embodiments, the buffer system contains magnesium. In some embodiments, the molar ratio of NTP to magnesium ions ($Mg^{2+}$; e.g., $MgCl_2$) present in an IVT reaction is 1:1 to 1:5. For example, the molar ratio of NTP to magnesium ions may be 1:1, 1:2, 1:3, 1:4 or 1:5.

In some embodiments, the molar ratio of NTP plus cap analog (e.g., tricnucleotide cap, such as GAG) to magnesium ions ($Mg^{2+}$; e.g., $MgCl_2$) present in an IVT reaction is 1:1 to 1:5. For example, the molar ratio of NTP+trinucleotide cap (e.g., GAG) to magnesium ions may be 1:1, 1:2, 1:3, 1:4 or 1:5.

In some embodiments, the buffer system contains Tris-HCl, spermidine (e.g., at a concentration of 1-30 mM), TRITON® X-100 (polyethylene glycol p-(1,1,3,3-tetramethylbutyl)-phenyl ether) and/or polyethylene glycol (PEG).

The addition of nucleoside triphosphates (NTPs) to the 3' end of a growing RNA strand is catalyzed by a polymerase, such as T7 RNA polymerase, for example, any one or more of the T7 RNA polymerase variants (e.g., S43A and/or G47A) of the present disclosure. In some embodiments, the RNA polymerase (e.g., T7 RNA polymerase variant) is present in a reaction (e.g., an IVT reaction) at a concentration of 0.01 mg/ml to 1 mg/ml. For example, the RNA polymerase may be present in a reaction at a concentration of 0.01 mg/mL, 0.05 mg/ml, 0.1 mg/ml, 0.5 mg/ml or 1.0 mg/ml.

Surprisingly, use of the combination of a T7 RNAP variant (e.g., E42, S43, Y44, E45, M46, G47, A255, R257, or G259, e.g., S43A or G47A) as provided herein with a cap analog (e.g., $GpppA_{2'Ome}pG$), in an in vitro transcription reaction, for example, results in the production of RNA transcript, wherein greater than 80% of the RNA transcript produced includes a functional cap. In some embodiments, greater than 85% of the RNA transcript produced includes a functional cap. In some embodiments, greater than 90% of the RNA transcript produced includes a functional cap. In some embodiments, greater than 95% of the RNA transcript produced includes a functional cap. In some embodiments, greater than 96% of the RNA transcript produced includes a functional cap. In some embodiments, greater than 97% of the RNA transcript produced includes a functional cap. In some embodiments, greater than 98% of the RNA transcript produced includes a functional cap. In some embodiments, greater than 99% of the RNA transcript produced includes a functional cap.

Also surprising was the finding that use of a polynucleotide template that includes a 2'-deoxythymidine residue or 2'-deoxycytidine residue at template position +1 results in the production of RNA transcript, wherein greater than 80% (e.g., greater than 85%, greater than 90%, or greater than 95%) of the RNA transcript produced includes a functional cap. Thus, in some embodiments, a polynucleotide (e.g., DNA) template used, for example, in an IVT reaction, includes a 2'-deoxythymidine residue at template position +1. In other embodiments, a polynucleotide (e.g., DNA) template used, for example, in an IVT reaction, includes a 2'-deoxycytidine residue at template position +1.

Applications

The RNA transcripts produced according to the present disclosure include mRNA (including modified mRNA and/or unmodified RNA), lncRNA, self-replicating RNA, circular RNA, CRISPR guide RNA, and the like. In embodiments, the RNA is RNA (e.g., mRNA or self-replicating RNA) that encodes a polypeptide (e.g., a therapeutic polypeptide). Thus, the RNA transcripts produced using RNA polymerase variants of the present disclosure may be used in a myriad of applications.

For example, the RNA transcripts may be used to produce polypeptides of interest, e.g., therapeutic proteins, vaccine antigen, and the like. In some embodiments, the RNA transcripts are therapeutic RNAs. A therapeutic mRNA is an mRNA that encodes a therapeutic protein (the term 'protein' encompasses peptides). Therapeutic proteins mediate a variety of effects in a host cell or in a subject to treat a disease or ameliorate the signs and symptoms of a disease. For example, a therapeutic protein can replace a protein that is deficient or abnormal, augment the function of an endogenous protein, provide a novel function to a cell (e.g., inhibit or activate an endogenous cellular activity, or act as a delivery agent for another therapeutic compound (e.g., an antibody-drug conjugate). Therapeutic mRNA may be useful for the treatment of the following diseases and conditions: bacterial infections, viral infections, parasitic infections, cell proliferation disorders, genetic disorders, and autoimmune disorders. Other diseases and conditions are encompassed herein.

A protein of interest encoded by an mRNA as provided herein can be essentially any protein. In some embodiments, the therapeutic protein is a cytokine, a growth factor, an antibody or a fusion protein. Non-limiting examples of therapeutic proteins include blood factors (such as Factor VIII and Factor VII), complement factors, Low Density Lipoprotein Receptor (LDLR) and MUT1. Non-limiting examples of cytokines include interleukins, interferons, chemokines, lymphokines and the like. Non-limiting examples of growth factors include erythropoietin, EGFs, PDGFs, FGFs, TGFs, IGFs, TNFs, CSFs, MCSFs, GMCSFs and the like. Non-limiting examples of antibodies include adalimumab, infliximab, rituximab, ipilimumab, tocilizumab, canakinumab, itolizumab, tralokinumab. Non-limiting examples of fusion proteins include, for example, etanercept, abatacept and belatacept.

In some embodiments, the protein of interest is human erythropoietin, LDLR (for use in inhibiting cholesterol), or MUT1 (for use in the treatment of methylmalonic acidemia (MMA)). In other embodiments, the protein of interest encoded by the mRNA is a therapeutic antibody, including but not limited to the antibodies listed above.

A RNA transcript produced using a RNA polymerase variant as disclosed herein may encode one or more biologics. A biologic is a polypeptide-based molecule that may be used to treat, cure, mitigate, prevent, or diagnose a serious or life-threatening disease or medical condition. Biologics include, but are not limited to, allergenic extracts (e.g. for allergy shots and tests), blood components, gene therapy products, human tissue or cellular products used in transplantation, vaccines, monoclonal antibodies, cytokines, growth factors, enzymes, thrombolytics, and immunomodulators, among others.

One or more biologics currently being marketed or in development may be encoded by the RNA of the present invention. While not wishing to be bound by theory, it is believed that incorporation of the encoding polynucleotides of a known biologic into the RNA of the present disclosure will result in improved therapeutic efficacy due at least in part to the specificity, purity and/or selectivity of the construct designs.

A RNA transcript produced using a RNA polymerase variant as disclosed herein may encode one or more antibodies. The term "antibody" includes monoclonal antibodies (including full length antibodies which have an immunoglobulin Fc region), antibody compositions with polyepitopic specificity, multispecific antibodies (e.g., bispecific antibodies, diabodies, and single-chain molecules), as well as antibody fragments. The term "immunoglobulin" (Ig) is used interchangeably with "antibody" herein. A monoclonal antibody is an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site.

Monoclonal antibodies specifically include chimeric antibodies (immunoglobulins) in which a portion of the heavy and/or light chain is identical with or homologous to corresponding sequences in antibodies derived from a particular species or belonging to a particular antibody class or subclass, while the remainder of the chain(s) is(are) identical with or homologous to corresponding sequences in antibodies derived from another species or belonging to another antibody class or subclass, as well as fragments of such antibodies, so long as they exhibit the desired biological activity. Chimeric antibodies include, but are not limited to, "primatized" antibodies comprising variable domain antigen-binding sequences derived from a non-human primate (e.g., Old World Monkey, Ape etc.) and human constant region sequences.

Antibodies encoded in the RNA of the present disclosure may be utilized to treat conditions or diseases in many therapeutic areas such as, but not limited to, blood, cardiovascular, CNS, poisoning (including antivenoms), dermatology, endocrinology, gastrointestinal, medical imaging, musculoskeletal, oncology, immunology, respiratory, sensory and anti-infective.

A RNA transcript produced using a RNA polymerase variant as disclosed herein may encode one or more vaccine antigens. A vaccine antigen is a biological preparation that improves immunity to a particular disease or infectious agent. One or more vaccine antigens currently being marketed or in development may be encoded by the RNA of the present disclosure. Vaccine antigens encoded in the RNA may be utilized to treat conditions or diseases in many therapeutic areas such as, but not limited to, cancer, allergy and infectious disease. In some embodiments, a cancer vaccine may be a personalized cancer vaccine in the form of a concatemer or individual RNAs encoding peptide epitopes or a combination thereof.

A RNA transcript produced using a RNA polymerase variant as disclosed herein may be designed to encode on or more antimicrobial peptides (AMP) or antiviral peptides (AVP). AMPs and AVPs have been isolated and described from a wide range of animals such as, but not limited to, microorganisms, invertebrates, plants, amphibians, birds, fish, and mammals. The anti-microbial polypeptides may block cell fusion and/or viral entry by one or more enveloped viruses (e.g., HIV, HCV). For example, the anti-microbial polypeptide can comprise or consist of a synthetic peptide corresponding to a region, e.g., a consecutive sequence of at least about 5, 10, 15, 20, 25, 30, 35, 40, 45, 50, 55, or 60 amino acids of the transmembrane subunit of a viral envelope protein, e.g., HIV-1 gp120 or gp41. The amino acid and nucleotide sequences of HIV-1 gp120 or gp41 are described in, e.g., Kuiken et al., (2008). "HIV Sequence Compendium," Los Alamos National Laboratory.

In some embodiments, RNA transcripts are used as radio-labeled RNA probes. In some embodiments, RNA transcripts are used for non-isotopic RNA labeling. In some embodiments, RNA transcripts are used as guide RNA (gRNA) for gene targeting. In some embodiments, RNA transcripts (e.g., mRNA) are used for in vitro translation and micro injection. In some embodiments, RNA transcripts are used for RNA structure, processing and catalysis studies. In some embodiments, RNA transcripts are used for RNA amplification. In some embodiments, RNA transcripts are used as anti-sense RNA for gene expression experiment. Other applications are encompassed by the present disclosure.

Compositions

The T7 RNAP variants of the present disclosure, in some embodiments when used in combination with a cap analog, such as a trinucleotide cap, in an IVT reaction produces RNA that does not induce a detectable cytokine response, even in the absence of post-IVT purification. Thus, provided herein, in some embodiments, are composition comprising IVT RNA and a pharmaceutically acceptable excipient, wherein the composition is substantially free (e.g., does not comprise, or comprises less than 10%, less than 1%, less than 0.1%, or less than 0.01%) of cytokine-inducing RNA contaminant in the absence of post-IVT purification.

As described elsewhere herein, the T7 RNAP variants and methods of the present disclosure produce RNA transcript, wherein at least 80% (e.g., 80%-90%, 80-95%, 90-95%, 80-99%, 90-99%, or 90-100%) of the transcript includes a functional cap. Thus, also provided herein are composition comprising an IVT RNA and a pharmaceutically acceptable excipient, wherein the composition comprises less than 20% (e.g., 5-15%, 5-10%, 1-15%, or 1-10%) uncapped RNA species. In some embodiments, the composition comprises less than 15% (e.g., 5-10%, 1-10%, or 1-5%) uncapped RNA species. In some embodiments, the composition comprises less than 10% uncapped RNA species. In some embodiments, the composition comprises less than 5% uncapped RNA species.

In some embodiments, greater than 80% of the IVT RNA includes a functional cap. In some embodiments, greater than 85% of the IVT RNA includes a functional cap. In some embodiments, greater than 90% of the IVT RNA includes a functional cap. In some embodiments, greater than 95% of the IVT RNA includes a functional cap.

The IVT RNA, in some embodiments, is not chemically modified, while in other embodiments, the IVT RNA is chemically modified.

In some embodiments, unexpectedly, greater than 80% of the IVT RNA comprises single-stranded full-length transcripts. For example, greater than 85% of the IVT RNA may comprise single-stranded full-length transcripts. In some embodiments, greater than 90% of the IVT RNA comprises single-stranded full-length transcripts. greater than 95% of the IVT RNA comprises single-stranded full-length transcripts.

In some embodiments, the RNA is produced by a process comprising reacting a polynucleotide template with (a) a T7 RNA polymerase variant comprising at least one amino acid substitution, relative to wild-type RNA polymerase, that causes at least one loop structure of the RNA polymerase variant to undergo a conformational change to a helix structure as the RNA polymerase variant transitions from an initiation complex to an elongation complex, (b) nucleoside triphosphates, and (c) a trinucleotide cap comprising sequence $GpppA_{2'OMe}pG$, under in vitro transcription reaction conditions to produce RNA transcript, wherein the polynucleotide template includes a 2'-deoxythymidine residue at template position +1.

Kits

Also provided herein are kits, such as in vitro transcription kits comprising a RNA polymerase variant of the present disclosure. The kits may comprise any one or more (at least one) IVT component described herein and any one or more (at least one) RNA polymerase variant. For example, a kit may include a buffer system, NTPs and a T7 RNA polymerase variant having an amino acid sequence of SEQ ID NO:1, 99, or 100 having at least one (or at least two, or at least three) amino acid substitution at position E42, S43, Y44, E45, M46, G47, A255, R257, A258, G259, A260, L261 and/or A262 and optionally at least one amino acid addition on the C-terminal end.

Additional Embodiments

Additional embodiments of the present disclosure are encompassed by the following numbered paragraphs:

1. A ribonucleic acid (RNA) polymerase variant comprising at least one amino acid substitution, relative to wild-type RNA polymerase, that causes at least one loop structure of the RNA polymerase variant to undergo a conformational change to a helix structure as the RNA polymerase variant transitions from an initiation complex to an elongation complex.

2. The RNA polymerase variant of paragraph 1, wherein the at least one amino acid substitution has a higher helix propensity, relative to wild-type amino acid.

3. The RNA polymerase variant of paragraph 1 or 2, wherein the RNA polymerase is a T7 RNA polymerase.

4. The RNA polymerase variant of any one of paragraphs 1-3, wherein the at least one loop structure is in a C-helix structure.

5. The RNA polymerase variant of any one of paragraphs 1-4, wherein the at least one loop structure is in a C-linker structure.

6. The RNA polymerase variant of any one of paragraphs 1-4, wherein the at least one amino acid substitution is at least one high-helix propensity amino acid substitution.

7. The RNA polymerase variant of paragraph 6, wherein the at least one high-helix propensity acid substitution is selected from alanine, isoleucine, leucine, methionine, lysine, glutamine, and/or glutamate.

8. The RNA polymerase variant of paragraph 7, wherein the at least one high-helix propensity amino acid substitution is alanine.

9. The RNA polymerase variant of any one of paragraphs 4-8, wherein the T7 RNA polymerase comprising an amino acid sequence identified by SEQ ID NO:1, SEQ ID NO:99, or SEQ ID NO:100 modified to include at least one amino acid substitution of a high-helix propensity amino acid at a position selected from E42, S43, Y44, E45, M46, G47, R257, and G259.

10. The RNA polymerase variant of paragraph 9, wherein that at least one amino acid substitution comprises S43A.

11. The RNA polymerase variant of paragraph 9, wherein that at least one amino acid substitution comprises G47A.

12. The RNA polymerase variant of any one of paragraphs 5-8, wherein the T7 RNA polymerase comprising an amino acid sequence identified by SEQ ID NO:1, SEQ ID NO:99, or SEQ ID NO:100 modified to include at least one amino acid substitution of a high-helix propensity amino acid at a position selected from R257, A258, G259, A260, L261 and A262.

13. The RNA polymerase variant of paragraph 12, wherein the at least one amino acid substitution comprises R257A.

14. The RNA polymerase variant of paragraph 12, wherein the at least one amino acid substitution comprises G259A.

15. A T7 ribonucleic acid (RNA) polymerase comprising an amino acid sequence identified by SEQ ID NO:1, SEQ ID NO:99, or SEQ ID NO:100 modified to include an amino acid substitution of a high-helix propensity amino acid at position G47, S43, R257, or G259.

16. The T7 RNA polymerase of paragraph 15, wherein the high-helix propensity amino acid is selected from alanine, isoleucine, leucine, methionine, lysine, glutamine, and/or glutamate.

17. The T7 RNA polymerase of paragraph 16, wherein the high-helix propensity amino acid is alanine.

18. A T7 RNA polymerase comprising an amino acid sequence identified by SEQ ID NO:2, SEQ ID NO:107, or SEQ ID NO:108.

19. A T7 RNA polymerase comprising an amino acid sequence identified by SEQ ID NO:3, SEQ ID NO:109, or SEQ ID NO:110.

20. A T7 RNA polymerase comprising an amino acid sequence identified by SEQ ID NO:4, SEQ ID NO:111, or SEQ ID NO:112.

21. A T7 RNA polymerase comprising an amino acid sequence identified by SEQ ID NO:5, SEQ ID NO:113, or SEQ ID NO:114.

22. A method of producing a ribonucleic acid (RNA) comprising contacting a DNA template with the RNA polymerase of any one of paragraphs 1-21 under conditions that result in the production of RNA transcript.

23. A method of performing an in vitro transcription (IVT) reaction, comprising contacting a DNA template with the RNA polymerase of any one of paragraphs 1-21 in the presence of nucleoside triphosphates and buffer under conditions that result in the production of RNA transcripts.

24. The method of paragraph 23, wherein the RNA transcript produced, when delivered to cells, optionally in unpurified form, stimulates cytokine response that is at least 50% lower relative to RNA produced using wild-type RNA polymerase.

25. The method of any of paragraphs 23-24, wherein the concentration of double-stranded RNA transcript produced by IVT is at least 50% lower relative to dsRNA transcript produced using wild-type polymerase.

26. The method of any one of paragraphs 23-25, wherein less than 20% of the RNA transcripts produced exhibit 3' heterogeneity.

27. The method of any one of paragraphs 23-26, wherein less than 50% of the RNA transcript produced is truncated RNA transcript.

28. The method of any one of paragraphs 23-28, wherein less than 50% of the RNA transcript produced is run-on RNA transcript.

29. The method of any one of paragraphs 23-28, wherein the amount of full-length RNA transcript produced is at least 15 times greater than the amount of the DNA template 30. The method of any one of paragraphs 23-29, wherein the ratio of truncated RNA transcript:full-length RNA transcript produced is less than 1:1.

31. The method of any one of paragraphs 23-30, wherein the RNA transcript produced has less than 1 mutation per 100 nucleotides relative to the DNA template.

32. A nucleic acid encoding the RNA polymerase of any one of paragraphs 1-21.

33. A vector comprising the nucleic acid of paragraph 33.

34. A host cell comprising the nucleic acid of paragraph 33 or the vector of paragraph 34.

35. A kit comprising the RNA polymerase of any one of paragraphs 1-21.

36. A composition comprising the RNA polymerase of any one of paragraphs 1-21.

37. A ribonucleic acid (RNA) produced by the method of any one of paragraphs 22-31.

38. The RNA of paragraph 37 formulated in a lipid nanoparticle.

39. The RNA of paragraph 38, wherein the lipid nanoparticle comprises a molar ratio of 20-60% ionizable amino lipid, 5-25% non-cationic lipid, 25-55% sterol, and 0.5-15% PEG-modified lipid.

40. A co-transcriptional capping method for ribonucleic acid (RNA) synthesis, the method comprising reacting a polynucleotide template with a T7 RNA polymerase variant, nucleoside triphosphates, and a cap analog under in vitro transcription reaction conditions to produce RNA transcript.

41. The method of paragraph 40, wherein greater than 80%, greater than 85%, or greater than 90% of the RNA transcript produced includes a functional cap.

42. The method of paragraph 41, wherein greater than 95% of the RNA transcript produced includes a functional cap.

43. The method of any one of paragraphs 40-42, wherein the nucleoside triphosphates comprise unmodified or modified ATP, modified or unmodified UTP, modified or unmodified GTP, and/or modified or unmodified CTP.

44. The method of any one of paragraphs 40-43, wherein the T7 RNA polymerase variant is a T7 polymerase variant of any one of paragraph 1-21.

45. The method of paragraph 44, wherein the T7 polymerase variant comprises an amino acid sequence identified by SEQ ID NO:1, SEQ ID NO:99, or SEQ ID NO:100 modified to include at least one amino acid substitution of a high-propensity amino acid at a position selected from E42, S43, Y44, E45, M46, G47, R257, and G259.

46. The method of any one of paragraphs 40-45, the T7 polymerase variant comprises an amino acid sequence identified by SEQ ID NO:1, SEQ ID NO:99, or SEQ ID NO:100 modified to include amino acid substitution of G47A.

47. The method of any one of paragraphs 40-45, the T7 polymerase variant comprises an amino acid sequence identified by SEQ ID NO:1, SEQ ID NO:99, or SEQ ID NO:100 modified to include amino acid substitution of S43A.

48. The method of any one of paragraphs 40-47, wherein the nucleoside triphosphates and cap analog are present in the reaction at equimolar concentrations.

49. The method of any one of paragraphs 40-47, wherein a molar ratio of cap analog to nucleoside triphosphates in the reaction is greater than 1:1.

50. The method of any one of paragraphs 40-47, wherein a molar ratio of cap analog to nucleoside triphosphates in the reaction is less than 1:1.

51. The method of any one of paragraphs 40-50, wherein the cap analog is a dinucleotide cap, a trinucleotide cap, or a tetranucleotide cap.

52. The method of any one of paragraphs 40-50, wherein the cap analog is a trinucleotide cap.

53. The method of paragraph 51, wherein the trinucleotide cap comprises a sequence selected from the following sequences: GAA, GAC, GAG, GAU, GCA, GCC, GCG, GCU, GGA, GGC, GGG, GGU, GUA, GUC, GUG, and GUU.

54. The method of paragraph 53, wherein the trinucleotide cap comprises a sequence selected from the following sequences: m$^7$GpppApA, m$^7$GpppApC, m$^7$GpppApG, m$^7$GpppApU, m$^7$GpppCpA, m$^7$GpppCpC, m$^7$GpppCpG, m$^7$GpppCpU, m$^7$GpppGpA, m$^7$GpppGpC, m$^7$GpppGpG, m$^7$GpppGpU, m$^7$GpppUpA, m$^7$GpppUpC, m$^7$GpppUpG, and m$^7$GpppUpU.

55. The method of paragraph 53, wherein the trinucleotide cap comprises a sequence selected from the following sequences: m$^7$G$_{3'OMe}$pppApA, m$^7$G$_{3'OMe}$pppApC, m$^7$G$_{3'OMe}$pppApG, m$^7$G$_{3'OMe}$pppApU, m$^7$G$_{3'OMe}$pppCpA, m$^7$G$_{3'OMe}$pppCpC, m$^7$G$_{3'OMe}$pppCpG, m$^7$G$_{3'OMe}$pppCpU, m$^7$G$_{3'OMe}$pppGpA, m$^7$G$_{3'OMe}$pppGpC, m$^7$G$_{3'OMe}$pppGpG, m$^7$G$_{3'OMe}$pppGpU, m$^7$G$_{3'OMe}$pppUpA, m$^7$G$_{3'OMe}$pppUpC, m$^7$G$_{3'OMe}$pppUpG, and m$^7$G$_{3'OMe}$pppUpU.

56. The method of paragraph 53, wherein the trinucleotide cap comprises a sequence selected from the following sequences: m$^7$G$_{3'OMe}$pppA$_{2'OMe}$pA, m$^7$G$_{3'OMe}$pppA$_{2'OMe}$pC, m$^7$G$_{3'OMe}$pppA$_{2'OMe}$pG, m$^7$G$_{3'OMe}$pppA$_{2'OMe}$pU, m$^7$G$_{3'OMe}$pppC$_{2'OMe}$pA, m$^7$G$_{3'OMe}$pppC$_{2'OMe}$pC, m$^7$G$_{3'OMe}$pppC$_{2'OMe}$pG, m$^7$G$_{3'OMe}$pppC$_{2'OMe}$pU, m$^7$G$_{3'OMe}$pppG$_{2'OMe}$pA, m$^7$G$_{3'OMe}$pppG$_{2'OMe}$pC, m$^7$G$_{3'OMe}$pppG$_{2'OMe}$pG, m$^7$G$_{3'OMe}$pppG$_{2'OMe}$pU, m$^7$G$_{3'OMe}$pppU$_{2'OMe}$pA, m$^7$G$_{3'OMe}$pppU$_{2'OMe}$pC, m$^7$G$_{3'OMe}$pppU$_{2'OMe}$pG, and m$^7$G$_{3'OMe}$pppU$_{2'OMe}$pU.

57. The method of paragraph 53, wherein the trinucleotide cap comprises a sequence selected from the following sequences: m$^7$GpppA$_{2'OMe}$pA, m$^7$GpppA$_{2'OMe}$pC, m$^7$GpppA$_{2'OMe}$pG, m$^7$GpppA$_{2'OMe}$pU, m$^7$GpppC$_{2'OMe}$pA, m$^7$GpppC$_{2'OMe}$pC, m$^7$GpppC$_{2'OMe}$pG, m$^7$GpppC$_{2'OMe}$pU, m$^7$GpppG$_{2'OMe}$pA, m$^7$GpppG$_{2'OMe}$pC, m$^7$GpppG$_{2'OMe}$pG, m$^7$GpppG$_{2'OMe}$pU, m$^7$GpppU$_{2'OMe}$pA, m$^7$GpppU$_{2'OMe}$pC, m$^7$GpppU$_{2'OMe}$pG, and m$^7$GpppU$_{2'OMe}$pU.

58. The method of any one of paragraphs 53-57, wherein the trinucleotide cap comprises a sequence selected from the following sequences: GAG, GCG, GUG, and GGG.

59. The method of paragraph 58, wherein the trinucleotide cap comprises sequence GAG.

60. The method of paragraph 59, wherein the trinucleotide cap comprises GpppA$_{2'OMe}$pG.

61. The method of any one of paragraphs 40-60, wherein the polynucleotide template includes a 2'-deoxythymidine residue at template position +1.

62. The method of any one of paragraphs 40-60, wherein the polynucleotide template includes a 2'-deoxycytidine residue at template position +1.

63. A co-transcriptional capping method for RNA synthesis, the method comprising reacting a polynucleotide template with (a) a T7 RNA polymerase variant comprising at least one amino acid substitution, relative to wild-type RNA polymerase, that causes at least one loop structure of the RNA polymerase variant to undergo a conformational change to a helix structure as the RNA polymerase variant transitions from an initiation complex to an elongation complex, (b) nucleoside triphosphates, and (c) a trinucleotide cap comprising sequence GpppA$_{2'OMe}$pG, under in vitro transcription reaction conditions to produce RNA transcript, wherein the polynucleotide template includes a 2'-deoxythymidine residue at template position +1.

64. The method of any one of paragraph 40-63, wherein the RNA transcript produced, when delivered to cells, optionally in unpurified form, does not stimulate a detectable cytokine response.

65. A composition comprising an in vitro-transcribed (IVT) RNA and a pharmaceutically acceptable excipient, wherein the composition is substantially free of cytokine-inducing RNA contaminant in the absence of post-IVT purification.

66. A composition comprising an in vitro-transcribed (IVT) RNA and a pharmaceutically acceptable excipient, wherein the composition has less than 5% uncapped RNA species.

67. The composition of paragraph 65 or 66, wherein greater than 80%, 85%, or 90% of the IVT RNA include a functional cap.

68. The composition of paragraph 67, wherein greater than 95% of the IVT RNA include a functional cap.

69. The composition of any one of paragraphs 65-68, wherein the IVT RNA is not chemically modified.

70. The composition of any one of paragraphs 65-68, wherein the IVT RNA is chemically modified.

71. The composition of any one of paragraphs 65-70, wherein greater than 95% of the IVT RNA comprises single-stranded full-length transcripts.

72. The composition of any one of paragraphs 65-71, wherein the RNA is produced by a process comprising:

reacting a polynucleotide template with (a) a T7 RNA polymerase variant comprising at least one amino acid substitution, relative to wild-type RNA polymerase, that causes at least one loop structure of the RNA polymerase variant to undergo a conformational change to a helix structure as the RNA polymerase variant transitions from an initiation complex to an elongation complex, (b) nucleoside triphosphates, and (c) a trinucleotide cap comprising sequence GpppA$_{2'Ome}$pG, under in vitro transcription reaction conditions to produce RNA transcript, wherein the polynucleotide template includes a 2'-deoxythymidine residue at template position +1.

73. A T7 RNA polymerase comprising at least one additional C-terminal amino acid relative to wild-type T7 RNA polymerase.

74. The T7 RNA polymerase of paragraph 73 comprising at least two additional C-terminal amino acids.

75. The T7 RNA polymerase of paragraph 74, wherein the at least two additional C-terminal amino acids comprise the same type of amino acid or at least two different types of amino acids.

76. The T7 RNA polymerase of any one of paragraphs 73-75 comprising 1 to 10 additional C-terminal amino acids.

77. The T7 RNA polymerase of paragraph 76 comprising 1 to 5 additional C-terminal amino acids.

78. The T7 RNA polymerase of any one of paragraphs 73-77, wherein the T7 RNA polymerase comprises a C terminus that comprises a FAFAX$_n$ (SEQ ID NO; 171) motif, wherein X is any amino acid and n is any integer greater than zero.

79. The T7 RNA polymerase of paragraph 78, wherein X is G or A, and optionally wherein X$_n$ is GG or AA.

80. The T7 RNA polymerase of paragraph 78 or 79, wherein n is 1, 2, 3, 4, or 5.

81. A T7 RNA polymerase comprising a C terminus that comprises a FAFAG (SEQ ID NO: 329) motif.

82. A T7 RNA polymerase comprising a C terminus that comprises a XAFAX$_n$ motif, a FXFAX$_n$ motif, FAXAX$_n$ motif, or a FAFXX$_n$ motif, wherein each X is any amino acid and n is any integer greater than zero.

83. The T7 RNA polymerase of any one of paragraphs 73-82, wherein the T7 RNA polymerase comprises at least one substitution at a position corresponding to position S43, G47, R257, or G259 of a wild-type T7 RNA polymerase, and optionally at least one additional amino acid substitution.

84. The T7 RNA polymerase of paragraph 83, wherein the wild-type T7 RNA polymerase comprises an amino acid sequence identified by SEQ ID NO:1.

85. A T7 RNA polymerase comprising an amino acid sequence of SEQ ID NO:99 modified to include at least one substitution selected from G47, S43, R257, and G259, and optionally at least one additional amino acid substitution.

86. A T7 RNA polymerase comprising an amino acid sequence of any one of SEQ ID NOs:100, 294, 296, or 296 modified to include at least one substitution selected from G47, S43, R257, and G259, and optionally at least one additional amino acid substitution.

87. The T7 RNA polymerase of any one of paragraphs 83-86, comprising at least one substitution selected from S43A, G47A, R257A, and G259A.

88. A T7 RNA polymerase comprising an amino acid sequence of any one of SEQ ID NOs: 294-313, wherein x is any amino acid and n is any integer, e.g., between 1 and 5 (e.g., 1, 2, 3, 4, or 5), and optionally wherein the T7 RNA polymerase further comprises at least one additional amino acid substitution.

89. A method of performing an in vitro transcription (IVT) reaction, comprising contacting a DNA template with the RNA polymerase of any one of paragraphs 73-88 in the presence of nucleoside triphosphates and buffer under conditions that result in the production of RNA transcripts.

90. The method of paragraph 89, wherein the RNA produced, when delivered to cells stimulates a cytokine response that is at least 50% lower relative to the dsRNA transcript produced using a WT T7 RNAP.

91. The method of paragraph 90, wherein the RNA is delivered to the cells in unpurified form.

92. The method of any one of paragraphs 89-92, wherein less than 30% of the RNA transcripts produced exhibit 3' heterogeneity.

93. A nucleic acid encoding the RNA polymerase of any one of paragraphs 73-92.

94. A vector comprising the nucleic acid of paragraph 93.

95. A host cell comprising the nucleic acid of paragraph 93 or the vector of paragraph 94.

96. A kit comprising the RNA polymerase of any one of paragraphs 73-92.

97. A composition comprising the RNA polymerase of any one of paragraphs 73-92.

98. A ribonucleic acid (RNA) produced by the method of any one of paragraphs 89-92.

99. The RNA of paragraph 98 formulated in a lipid nanoparticle.

100. The RNA of paragraph 98, wherein the lipid nanoparticle comprises a molar ratio of 20-60% ionizable amino lipid, 5-25% non-cationic lipid, 25-55% sterol, and 0.5-15% PEG-modified lipid.

101. An RNA polymerase comprising at least one additional C-terminal amino acid relative to a corresponding wild-type RNA polymerase, optionally wherein the at least one additional C-terminal amino acid comprises glycine (G) and/or alanine (A).

102. The RNA polymerase of paragraph 101, wherein the RNA polymerase is selected from T7 RNA polymerases, T3 RNA polymerases, and SP6 RNA polymerases.

103. The RNA polymerase of paragraph 101 or 102, wherein the RNA polymerase further comprises at least one additional amino acid substitution, optionally further comprising an amino acid substitution corresponding to an amino acid substitution of SEQ ID NO:1 selected from S43A, G47A, R257A, and G259A.

104. The RNA polymerase of any one of paragraphs 101-104, wherein the RNA polymerase is a T7 RNA polymerase comprising an amino acid sequence at least 90%, at least 95%, or at least 98% identical to SEQ ID NO:1 modified to include an amino acid substitution at position 43, 47, 257, and/or 259, optionally wherein the amino acid substitution is alanine (A).

105. The RNA polymerase of any one of paragraphs 101-104, wherein the RNA polymerase is a T3 RNA polymerase comprising an amino acid sequence at least 90%, at least 95%, or at least 98% identical to SEQ ID NO:6 modified to include an amino acid substitution at position 44, 48, 258, and/or 260, optionally wherein the amino acid substitution is alanine (A).

106. The RNA polymerase of any one of paragraphs 101-104, wherein the RNA polymerase is a SP6 RNA polymerase comprising an amino acid sequence at least 90%, at least 95%, or at least 98% identical to SEQ ID NO:7 modified to include an amino acid substitution at position 15, 19, 230, and/or 232, optionally wherein the amino acid substitution is alanine (A).

107. A T7 RNA polymerase comprising an amino acid sequence at least 90%, at least 95%, or at least 98% identical to SEQ ID NO:1 modified to include an amino acid substitution at position 43, 47, 257, and/or 259, optionally wherein the amino acid substitution is alanine (A).

108. A T3 RNA polymerase comprising an amino acid sequence at least 90%, at least 95%, or at least 98% identical to SEQ ID NO:6 modified to include an amino acid substitution at position 44, 48, 258, and/or 260, optionally wherein the amino acid substitution is alanine (A).

109. A SP6 RNA polymerase comprising an amino acid sequence at least 90%, at least 95%, or at least 98% % identical to SEQ ID NO:7 modified to include an amino acid substitution at position 15, 19, 230, and/or 232, optionally wherein the amino acid substitution is alanine (A).

TABLE 1

RNA Polymerase Sequences

| RNA Polymerase | Amino Acid Sequence | SEQ ID NO |
|---|---|---|
| T7 RNA Polymerase | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 1 |
| T3 RNA Polymerase | MNIIENIEKNDFSEIELAAIPENTLADHYGSALAKEQLALEHESYELGERR FLKMLERQAKAGEIADNAAAKPLLATLLPKLTTRIVEWLEEYASKKGRKPS AYAPLQLLKPEASAFITLKVILASLTSTNMTTIQAAAGMLGKAIEDEARFG RIRDLEAKHFKKHVEEQLNKRHGQVYKKAFMQVVEADMIGRGLLGGEAWSS WDKETTMHVGIRLIEMLIESTGLVELQRHNAGNAGSDHEALQLAQEYVDVL AKRAGALAGISPMFQPCVVPPKPWVAITGGGYWANGRRPLALVRTHSKKGL MRYEDVYMPEVYKAVNLAQNTAWKINKKVLAVVNEIVNWKNCPVADIPSLE RQELPPKPDDIDTNEAALKEWKKAAAGIYRLDKARVSRRISLEFMLEQANK FASKKAIWFPYNMDWRGRVYAVPMFNPQGNDMTKGLLTLAKGKPIGEEGFY WLKIHGANCAGVDKVPFPERIAFIEKHVDDILACAKDPINNTWWAEQDSPF CFLAFCFEYAGVTHHGLSYNCSLPLAFDGSCSGIQHFSAMLRDEVGGRAVN LLPSETVQDIYGIVAQKVNEILKQDAINGTPNEMITVTDKDTGEISEKLKL GTSTLAQQWLAYGVTRSVTKRSVMTLAYGSKEFGFRQQVLDDTIQPAIDSG KGLMFTQPNQAAGYMAKLIWDAVSVTVVAAVEAMNWLKSAAKLLAAEVKDK KTKEILRHCAVHWTTPDGFPVWQEYRKPLQKRLDMIFLGQFRLQPTINTL KDSGIDAHKQESGIAPNEVHSQDGSHLRMTVVYAHEKYGIESEALIHDSFG TIPADAGKLFKAVRETMVITYENNDVLADFYSQFADQLHETQLDKMPPLPK KGNLNLQDILKSDFAFA | 6 |
| SP6 RNA Polymerase | MQDLHAIQLQLEEEMFNGGIRRFEADQQRQIAAGSESDTAWNRRLLSELIA PMAEGIQAYKEEYEGKKGRAPRALAFLQCVENEVAAYITMKVVMDMLNTDA TLQAIAMSVAERIEDQVRFSKLEGHAAKYFEKVKKSLKASRTKSYRHAHNV AVVAEKSVAEKDADFDRWEAWPKETQLQIGTTLLEILEGSVFYNGEPVFMR AMRTYGGKTIYYLQTSESVGQWISAFKEHVAQLSPAYAPCVIPPRPWRTPF NGGFHTEKVASRIRLVKGNREHVRKLTQKQMPKVYKAINALQNTQWQINKD VLAVIEEVIRLDLGYGVPSFKPLIDKENKPANPVPVEFQHLRGRELKEMLS PEQWQQFINWKGECARLYTAETKRGSKSAAVVRMVGQARKYSAFESIYFVY AMDSRSRVYVQSSTLSPQSNDLGKALLRFTEGRPVNGVEALKWFCINGANL WGWDKKTFDVRVSNVLDEEFQDMCRDIAADPLTFTQWAKADAPYEFLAWCF EYAQYLDLVDEGRADEFRTHLPVHQDGSCSGIQHYSAMLRDEVGAKAVNLK PSDAPQDIYGAVAQVVIKKNALYMDADDATTFTSGSVTLSGTELRAMASAW DSIGITRSLTKKPVMTLPYGSTRLTCRESVIDYIVDLEEKEAQKAVAEGRT ANKVHPFEDDRQDYLTPGAAYNYMTALIWPSISEVVKAPIVAMKMIRQLAR FAAKRNEGLMYTLPTGFILEQKIMATEMLRVRTCLMGDIKMSLQVETDIVD EAAMMGAAAPNFVHGHDASHLILTVCELVDKGVTSIAVIHDSFGTHADNTL TLRVALKGQMVAMYIDGNALQKLLEEHEVRWMVDTGIEVPEQGEFDLNEIM DSEYVFA | 7 |
| K11 RNA Polymerase | MNALNIGRNDFSEIELAAIPYNILSEHYGDQAAREQLALEHEAYELGRQRF LKMLERQVKAGEFADNAAAKPLVLTLHPQLTKRIDDWKEEQANARGKKPRA YYPIKHGVASELAVSMGAEVLKEKRGVSSEAIALLTIKVVLGNAHRPLKGH NPAVSSQLGKALEDEARFGRIREQEAAYFKKNVADQLDKRVGHVYKKAFMQ VVEADMISKGMLGGDNWASWKTDEQMHVGTKLLELLIEGTGLVEMTKNKMA DGSDDVTSMQMVQLAPAFVELLSKRAGALAGISPMHQPCVVPPKPWVETVG GGYWSVGRRPLALVRTHSKKALRRYADVHMPEVYKAVNLAQNTPWKVNKKV LAVVNEIVNWKHCPVGDVPAIEREELPPRPDDIDTNEVARKAWRKEAAAVY RKDKARQSRRCRCEFMVAQANKFANHKAIWFPYNMDWRGRVYAVSMFNPQG NDMTKGSLTLAKGKPIGLDGFYWLKIHGANCAGVDKVPFPERIKFIEENEG NILASAADPLNNTWWTQQDSPFCFLAFCFEYAGVKHHGLNYNCSLPLAFDG SCSGIQHFSAMLRDSIGGRAVNLLPSDTVQDIYKIVADKVNEVLHQHAVNG SQTVVEQIADKETGEFHEKVTLGESVLAAQWLQYGVTRKVTKRSVMTLAYG SKESLVRQQVLEDTIQPAIDNGEGLMFTHPNQAAGYMAKLIWDAVTVTVVA AVEAMNWLKSAAKLLAAEVKDKKTKEVLRKRCAIHWVTPDGFPVWQEYRKQ | 8 |

TABLE 1-continued

RNA Polymerase Sequences

| RNA Polymerase | Amino Acid Sequence | SEQ ID NO |
|---|---|---|
| | NQARLKLVFLGQANVKMTYNTGKDSEIDAHKQESGIAPNFVHSQDGSHLRM TVVHANEVYGIDSEALIHDSSGTIPADAGNLFKAVRETMVKTYEDNDVIAD FYDQFADQLHESQLDKMPAVPAKGDLNLRDILESDFAFA | |

TABLE 2

RNA Polymerase C-Terminal Variant Sequences

| RNA Polymerase | Amino Acid Sequence | SEQ ID NO |
|---|---|---|
| T7 RNA Polymerase C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 99 |
| T7 RNA Polymerase C-Terminal Variant (additional G) | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 100 |
| T3 RNA Polymerase C-Terminal Variant | MNIIENIEKNDFSEIELAAIPFNTLADHYGSALAKEQLALEHESYELGERR FLKMLERQAKAGEIADNAAAKPLLATLLPKLTTRIVEWLEEYASKKGRKPS AYAPLQLLKPEASAFITLKVILASLTSTNMTTIQAAAGMLGKAIEDEARFG RIRDLEAKHFKKHVEEQLNKRHGQVYKKAFMQVVEADMIGRGLLGGEAWSS WDKETTMHVGIRLIEMLIESTGLVELQRHNAGNAGSDHEALQLAQEYVNLN AKRAGALAGISPMFQPCVVPPKPWVAITGGGYWANGRRPLALVRTHSKKGL MRYEDVYMPEVYKAVNLAQNTAWKINKKVLAVVNEIVNWKNCPVADIPSLE RQELPPKPDDIDTNEAALKEWKKAAAGIYRLDKARVSRRISLEFMLEQANK FASKKAIWFPYNMDWRGRVYAVPMFNPQGNDMTKGLLTLAKGKPIGEEGFY WLKIHGANCAGVDKVPFPERIAFIEKHVDDILACAKDPINNTWWAEQDSPF CFLAFCFEYAGVTHHGLSYNCSLPLAFDGSCSGIQHFSAMLRDEVGGRAVN LLPSETVQDIYGIVAQKVNEILKQDAINGTPNEMITVTDKDTGEISEKLKL GTSTLAQQWLAYGVTRSVTKRSVMTLAYGSKEFGFRQQVLDDTIQPAIDSG KGLMFTQPNQAAGYMAKLIWDAVSVTVVAAVEAMNWLKSAAKLLAAEVKDK KTKEILRHRCAVHWTTPDGFPVWQEYRKPLQKRLDMIFLGQFRLQPTINTL KDSGIDAHKQESGIAPNFVHSQDGSHLRMTVVYAHEKYGIESFALIHDSFG TIPADAGKLFKAVRETMVITYENNDVLADFYSQFADQLHETQLDKMPPLPK KGNLNLQDILKSDFAFAX$_n$, where X is any amino acid and n is any integer, e.g., between 1 and 5 | 101 |
| T3 RNA Polymerase C- | MNIIENIEKNDFSEIELAAIPENTLADHYGSALAKEQLALEHESYELGERR FLKMLERQAKAGEIADNAAAKPLLATLLPKLTTRIVEWLEEYASKKGRKPS | 102 |

TABLE 2-continued

RNA Polymerase C-Terminal Variant Sequences

| RNA Polymerase | Amino Acid Sequence | SEQ ID NO |
|---|---|---|
| Terminal Variant | AYAPLQLLKPEASAFITLKVILASLTSTNMTTIQAAAGMLGKAIEDEARFG RIRDLEAKHFKKHVEEQLNKRHGQVYKKAFMQVVEADMIGRGLLGGEAWSS WDKETTMHVGIRLIEMLIESTGLVELQRHNAGNAGSDHEALQLAQEYVDVL AKRAGALAGISPMFQPCVVPPKPWVAITGGGYWANGRRPLALVRTHSKKGL MRYEDVYMPEVYKAVNLAQNTAWKINKKVLAVVNEIVNWKNCPVADIPSLE RQELPPKPDDIDTNEAALKEWKKAAAGIYRLDKARVSRRISLEFMLEQANK FASKKAIWFPYNMDWRGRVYAVPMFNPQGNDMTKGLLTLAKGKPIGEEGFY WLKIHGANCAGVDKVPFPERIAFIEKHVDDILACAKDPINNTWWAEQDSPF CFLAFCFEYAGVTHHGLSYNCSLPLAFDGSCSGIQHFSAMLRDEVGGRAVN LLPSETVQDIYGIVAQKVNEILKQDAINGTPNEMITVTDKDTGEISEKLKL GTSTLAQQWLAYGVTRSVTKRSVMTLAYGSKEFGFRQQVLDDTIQPAIDSG KGLMFTQPNQAAGYMAKLIWDAVSVTVVAAVEAMNWLKSAAKLLAAEVKDK KTKEILRHRCAVHWTTPDGFPVWQEYRKPLQKRLDMIFLGQFRLQPTINTL KDSGIDAHKQESGIAPNFVHSQDGSHLRMTVVYAHEKYGIESFALIHDSFG TIPADAGKLFKAVRETMVITYENNDVLADFYSQFADQLHETQLDKMPPLPK KGNLNLQDILKSDFAFAG | |
| SP6 RNA Polymerase C-Terminal Variant | MQDLHATQLQLEEEMENGGIRRFEADQQRQIAAGSESDTAWNRRLLSELIA PMAEGIQAYKEEYEGKKGRAPRALAFLQCVENEVAAYITMKVVMDMLNTDA TLQATAMSVAERIEDQVRFSKLEGHAAKYFEKVKKSLKASRTKSYRHAHNV AVVAEKSVAEKDADFDRWEAWPKETQLQIGTTLLEILEGSVFYNGEPVFMR AMRTYGGKTIYYLQTSESVGQWISAFKEHVAQLSPAYAPCVIPPRPWRTPF NGGFHTEKVASRIRLVKGNREHVRKLTQKQMPKVYKAINALQNTQWQINKD VLAVIEEVIRLDLGYGVPSFKPLIDKENKPANPVPVEFQHLRGRELKEMLS PEQWQQFINWKGECARLYTAETKRGSKSAAVVRMVGQARKYSAFESIYFVY AMDSRSRVYVQSSTLSPQSNDLGKALLRFTEGRPVNGVEALKWECINGANL WGWDKKTFDVRVSNVLDEEFQDMCRDIAADPLTFTQWAKADAPYEFLAWCF EYAQYLDLVDEGRADEFRTHLPVHQDGSCSGIQHYSAMLRDEVGAKAVNLK PSDAPQDIYGAVAQVVIKKNALYMDADDATTFTSGSVTLSGTELRAMASAW DSIGITRSLTKKPVMTLPYGSTRLTCRESVIDYIVDLEEKEAQKAVAEGRT ANKVHPFEDDRQDYLTPGAAYNYMTALIWPSISEVVKAPIVAMKMIRQLAR FAAKRNEGLMYTLPTGFILEQKIMATEMLRVRTCLMGDIKMSLQVETDIVD EAAMMGAAAPNFVHGHDASHLILTVCELVDKGVTSIAVIHDSFGTHADNTL TLRVALKGQMVAMYIDGNALQKLLEEHEVRWMVDTGIEVPEQGEFDLNEIM DSEYVFAX$_n$, where X is any amino acid and n is any integer, e.g., between 1 and 5 | 103 |
| SP6 RNA Polymerase C-Terminal Variant | MQDLHATQLQLEEEMENGGIRRFEADQQRQIAAGSESDTAWNRRLLSELIA PMAEGIQAYKEEYEGKKGRAPRALAFLQCVENEVAAYITMKVVMDMLNTDA TLQATAMSVAERIEDQVRFSKLEGHAAKYFEKVKKSLKASRTKSYRHAHNV AVVAEKSVAEKDADFDRWEAWPKETQLQIGTTLLEILEGSVFYNGEPVFMR AMRTYGGKTIYYLQTSESVGQWISAFKEHVAQLSPAYAPCVIPPRPWRTPF NGGFHTEKVASRIRLVKGNREHVRKLTQKQMPKVYKAINALQNTQWQINKD VLAVIEEVIRLDLGYGVPSFKPLIDKENKPANPVPVEFQHLRGRELKEMLS PEQWQQFINWKGECARLYTAETKRGSKSAAVVRMVGQARKYSAFESIYFVY AMDSRSRVYVQSSTLSPQSNDLGKALLRFTEGRPVNGVEALKWECINGANL WGWDKKTFDVRVSNVLDEEFQDMCRDIAADPLTFTQWAKADAPYEFLAWCF EYAQYLDLVDEGRADEFRTHLPVHQDGSCSGIQHYSAMLRDEVGAKAVNLK PSDAPQDIYGAVAQVVIKKNALYMDADDATTFTSGSVTLSGTELRAMASAW DSIGITRSLTKKPVMTLPYGSTRLTCRESVIDYIVDLEEKEAQKAVAEGRT ANKVHPFEDDRQDYLTPGAAYNYMTALIWPSISEVVKAPIVAMKMIRQLAR FAAKRNEGLMYTLPTGFILEQKIMATEMLRVRTCLMGDIKMSLQVETDIVD EAAMMGAAAPNFVHGHDASHLILTVCELVDKGVTSIAVIHDSFGTHADNTL TLRVALKGQMVAMYIDGNALQKLLEEHEVRWMVDTGIEVPEQGEFDLNEIM DSEYVFAG | 104 |
| K11 RNA Polymerase C-Terminal Variant | MNALNIGRNDFSEIELAAIPYNILSEHYGDQAAREQLALEHEAYELGRQRF LKMLERQVKAGEFADNAAAKPLVLTLHPQLTKRIDDWKEEQANARGKKPRA YYPIKHGVASELAVSMGAEVLKEKRGVSSEAIALLTIKVVLGNAHRPLKGH NPAVSSQLGKALEDEARFGRIREQEAAYFKKNVADQLDKRVGHVYKKAFMQ VVEADMISKGMLGGDNWASWKTDEQMHVGTKLLELLIEGTGLVEMTKNKMA DGSDDVTSMQMVQLAPAFVELLSKRAGALAGISPMHQPCVVPPKPWVETVG GGYWSVGRRPLALVRTHSKKALRRYADVHMPEVYKAVNLAQNTPWKVNKKV LAVVNEIVNWKHCPVGDVPAIEREELPPRPDDIDTNEVARKAWRKEAAAVY RKDKARQSRRCRCEFMVAQANKFANHKAIWFPYNMDWRGRVYAVSMFNPQG NDMTKGSLTLAKGKPIGLDGFYWLKIHGANCAGVDKVPFPERIKFIEENEG NILASAADPLNNTWWTQQDSPFCFLAFCFEYAGVKHHGLNYNCSLPLAFDG SCSGIQHFSAMLRDSIGGRAVNLLPSDTVQDIYKIVADKVNEVLHQHAVNG SQTVVEQIADKETGEFHEKVTLGESVLAAQWLQYGVTRKVTKRSVMTLAYG SKESLVRQQVLEDTIQPAIDNGEGLMFTHPNQAAGYMAKLIWDAVTVTVVA AVEAMNWLKSAAKLLAAEVKDKKTKEVLRKRCAIHWVTPDGFPVWQEYRKQ NQARLKLVFLGQANVKMTYNTGKDSEIDAHKQESGIAPNFVHSQDGSHLRM | 105 |

TABLE 2-continued

RNA Polymerase C-Terminal Variant Sequences

| RNA Polymerase | Amino Acid Sequence | SEQ ID NO |
|---|---|---|
| | TVVHANEVYGIDSFALIHDSSGTIPADAGNLFKAVRETMVKTYEDNDVIAD FYDQFADQLHESQLDKMPAVPAKGDLNLRDILESDFAFAX$_n$, where X is any amino acid and n is any integer, e.g., between 1 and 5 | |
| K11 RNA Polymerase C-Terminal Variant | MNALNIGRNDFSEIELAAIPYNILSEHYGDQAAREQLALEHEAYELGRQRF LKMLERQVKAGEFADNAAAKPLVLTLHPQLTKRIDDWKEEQANARGKKPRA YYPIKHGVASELAVSMGAEVLKEKRGVSSEAIALLTIKVVLGNAHRPLKGH NPAVSSQLGKALEDEARFGRIREQEAAYFKKNVADQLDKRVGHVYKKAFMQ VVEADMISKGMLGGDNWASWKTDEQMHVGTKLLELLIEGTGLVEMTKNKMA DGSDDVTSMQMVQLAPAFVELLSKRAGALAGISPMHQPCVVPPKPWVETVG GGYWSVGRRPLALVRTHSKKALRRYADVHMPEVYKAVNLAQNTPWKVNKKV LAVVNEIVNWKHCPVGDVPAIEREELPPRPDDIDTNEVARKAWRKEAAAVY RKDKARQSRRCRCEFMVAQANKFANHKAIWFPYNMDWRGRVYAVSMFNPQG NDMTKGSLTLAKGKPIGLDGFYWLKIHGANCAGVDKVPFPERIKFIEENEG NILASAADPLNNTWWTQQDSPFCFLAFCFEYAGVKHHGLNYNCSLPLAFDG SCSGIQHFSAMLRDSIGGRAVNLLPSDTVQDIYKIVADKVNEVLHQHAVNG SQTVVEQIADKETGEFHEKVTLGESVLAAQWLQYGVTRKVTKRSVMTLAYG SKESLVRQQVLEDTIQPAIDNGEGLMFTHPNQAAGYMAKLIWDAVTVTVVA AVEAMNWLKSAAKLLAAEVKDKKTKEVLRKRCAIHWVTPDGFPVWQEYRKQ NQARLKLVFLGQANVKMTYNTGKDSEIDAHKQESGIAPNFVHSQDGSHLRM TVVHANEVYGIDSFALIHDSSGTIPADAGNLFKAVRETMVKTYEDNDVIAD FYDQFADQLHESQLDKMPAVPAKGDLNLRDILESDFAFAG | 106 |

EXAMPLES

Example 1. Production of Variant T7 RNA Polymerases

C-helix and C-linker T7 RNA polymerase variants were generated with the substitutions shown in Tables 3 and 4.

TABLE 3

T7 RNA Polymerase Variants

| T7 RNA Polymerase Variants | Amino Acid Sequence | SEQ ID NO |
|---|---|---|
| S43A | MNTINIAKNDFSDIELAAIPFNTLADHYGERLAREQLALEHEAYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 2 |
| G47A | MNTINIAKNDFSDIELAAIPFNTLADHYGERLAREQLALEHESYEMAEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG | 3 |

TABLE 3-continued

T7 RNA Polymerase Variants

| T7 RNA Polymerase Variants | Amino Acid Sequence | SEQ ID NO |
|---|---|---|
| | TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| R257A | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TAAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 4 |
| G259A | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAAALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 5 |
| E42A | MNTINIAKNDFSDIELAAIPFNTLADHYGERLAREQLALEHASYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 9 |
| E42I | MNTINIAKNDFSDIELAAIPFNTLADHYGERLAREQLALEHISYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC | 10 |

TABLE 3-continued

T7 RNA Polymerase Variants

| T7 RNA Polymerase Variants | Amino Acid Sequence | SEQ ID NO |
|---|---|---|
| | FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| E42L | MNTINIAKNDFSDIELAAIPFNTLADHYGERLAREQLALEHLSYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 11 |
| E42M | MNTINIAKNDFSDIELAAIPENTLADHYGERLAREQLALEHMSYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 12 |
| E42K | MNTINIAKNDFSDIELAAIPENTLADHYGERLAREQLALEHKSYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 13 |
| E42Q | MNTINIAKNDFSDIELAAIPENTLADHYGERLAREQLALEHQSYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF | 14 |

TABLE 3-continued

T7 RNA Polymerase Variants

| T7 RNA Polymerase Variants | Amino Acid Sequence | SEQ ID NO |
|---|---|---|
| | ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | |
| S43I | MNTINIAKNDFSDIELAAIPFNTLADHYGERLAREQLALEHEIYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 15 |
| S43L | MNTINIAKNDFSDIELAAIPENTLADHYGERLAREQLALEHELYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 16 |
| S43M | MNTINIAKNDFSDIELAAIPENTLADHYGERLAREQLALEHEMYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 17 |
| S43K | MNTINIAKNDFSDIELAAIPENTLADHYGERLAREQLALEHEKYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM | 18 |

TABLE 3-continued

T7 RNA Polymerase Variants

| T7 RNA Polymerase Variants | Amino Acid Sequence | SEQ ID NO |
|---|---|---|
| | RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| S43Q | MNTINIAKNDFSDIELAAIPENTLADHYGERLAREQLALEHEQYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 19 |
| S43E | MNTINIAKNDFSDIELAAIPENTLADHYGERLAREQLALEHEEYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 20 |
| Y44A | MNTINIAKNDFSDIELAAIPFNTLADHYGERLAREQLALEHESAEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 21 |
| Y44I | MNTINIAKNDFSDIELAAIPFNTLADHYGERLAREQLALEHESIEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW | 22 |

TABLE 3-continued

T7 RNA Polymerase Variants

| T7 RNA Polymerase Variants | Amino Acid Sequence | SEQ ID NO |
|---|---|---|
| | HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | |
| Y44L | MNTINIAKNDFSDIELAAIPFNTLADHYGERLAREQLALEHESLEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 23 |
| Y44M | MNTINIAKNDFSDIELAAIPFNTLADHYGERLAREQLALEHESMEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 24 |
| Y44K | MNTINIAKNDFSDIELAAIPFNTLADHYGERLAREQLALEHESKEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 25 |
| Y44Q | MNTINIAKNDFSDIELAAIPFNTLADHYGERLAREQLALEHESQEMGEARF RKMFERQLKAGEVADNAAAKPLITTLLPKMIARINDWFEEVKAKRGKRPTA | 26 |

TABLE 3-continued

T7 RNA Polymerase Variants

| T7 RNA Polymerase Variants | Amino Acid Sequence | SEQ ID NO |
|---|---|---|
| | FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| Y44E | MNTINIAKNDFSDIELAAIPFNTLADHYGERLAREQLALEHESEEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 27 |
| E45A | MNTINIAKNDFSDIELAAIPFNTLADHYGERLAREQLALEHESYAMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 28 |
| E45I | MNTINIAKNDFSDIELAAIPFNTLADHYGERLAREQLALEHESYIMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 29 |

TABLE 3-continued

T7 RNA Polymerase Variants

| T7 RNA Polymerase Variants | Amino Acid Sequence | SEQ ID NO |
|---|---|---|
| E45L | MNTINIAKNDFSDIELAAIPFNTLADHYGERLAREQLALEHESYLMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 30 |
| E45M | MNTINIAKNDFSDIELAAIPFNTLADHYGERLAREQLALEHESYMMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 31 |
| E45K | MNTINIAKNDFSDIELAAIPFNTLADHYGERLAREQLALEHESYKMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 32 |
| E45Q | MNTINIAKNDFSDIELAAIPFNTLADHYGERLAREQLALEHESYQMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT | 33 |

TABLE 3-continued

T7 RNA Polymerase Variants

| T7 RNA Polymerase Variants | Amino Acid Sequence | SEQ ID NO |
|---|---|---|
| | IPADAANLFKAVRETMVDTYESCDVLADFYDQFADQLHESQLDKMPALPAK GNLNLRDILESDFAFA | |
| M46A | MNTINIAKNDFSDIELAAIPFNTLADHYGERLAREQLALEHESYEAGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 34 |
| M46I | MNTINIAKNDFSDIELAAIPFNTLADHYGERLAREQLALEHESYEIGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 35 |
| M46L | MNTINIAKNDFSDIELAAIPFNTLADHYGERLAREQLALEHESYELGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 36 |
| M46K | MNTINIAKNDFSDIELAAIPFNTLADHYGERLAREQLALEHESYEKGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK | 38 |

TABLE 3-continued

T7 RNA Polymerase Variants

| T7 RNA Polymerase Variants | Amino Acid Sequence | SEQ ID NO |
|---|---|---|
| | TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| M46Q | MNTINIAKNDFSDIELAAIPFNTLADHYGERLAREQLALEHESYEQGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 39 |
| M46E | MNTINIAKNDFSDIELAAIPFNTLADHYGERLAREQLALEHESYEEGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 40 |
| G47I | MNTINIAKNDFSDIELAAIPFNTLADHYGERLAREQLALEHESYEMIEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 41 |
| G47L | MNTINIAKNDFSDIELAAIPFNTLADHYGERLAREQLALEHESYEMLEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG | 42 |

TABLE 3-continued

T7 RNA Polymerase Variants

| T7 RNA Polymerase Variants | Amino Acid Sequence | SEQ ID NO |
|---|---|---|
| | TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| G47M | MNTINIAKNDFSDIELAAIPFNTLADHYGERLAREQLALEHESYEMMEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 43 |
| G47K | MNTINIAKNDFSDIELAAIPFNTLADHYGERLAREQLALEHESYEMKEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 44 |
| G47Q | MNTINIAKNDFSDIELAAIPFNTLADHYGERLAREQLALEHESYEMQEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 45 |
| G47E | MNTINIAKNDFSDIELAAIPFNTLADHYGERLAREQLALEHESYEMEEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC | 46 |

TABLE 3-continued

T7 RNA Polymerase Variants

| T7 RNA Polymerase Variants | Amino Acid Sequence | SEQ ID NO |
|---|---|---|
| | FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| A255I | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAII<br>TIAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 315 |
| A255K | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIK<br>TIAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 316 |
| A255Q | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIQ<br>TIAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 317 |
| A255Y | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIY<br>TIAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF | 318 |

TABLE 3-continued

T7 RNA Polymerase Variants

| T7 RNA Polymerase Variants | Amino Acid Sequence | SEQ ID NO |
|---|---|---|
| | ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| R257I | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TIAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 47 |
| R257L | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TLAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 48 |
| R257M | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TMAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 49 |
| R257K | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TKAGALAGISPMFQPCVVPPKPWTGITGGGYWANGRRPLALVRTHSKKALM | 50 |

TABLE 3-continued

T7 RNA Polymerase Variants

| T7 RNA Polymerase Variants | Amino Acid Sequence | SEQ ID NO |
|---|---|---|
| | RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| R257Q | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TQAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 51 |
| R257E | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TEAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 52 |
| A258I | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRIGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 53 |
| A258L | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW | 54 |

TABLE 3-continued

T7 RNA Polymerase Variants

| T7 RNA Polymerase Variants | Amino Acid Sequence | SEQ ID NO |
|---|---|---|
| | HKEDSIHVGVRCIEMLIESTGMVSLHRQNAGVVGQDSETIELAPEYAEAIA<br>TRLGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| A258M | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRMGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 55 |
| A258K | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRKGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 56 |
| A258Q | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRQGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 57 |
| A258E | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA | 58 |

TABLE 3-continued

T7 RNA Polymerase Variants

| T7 RNA Polymerase Variants | Amino Acid Sequence | SEQ ID NO |
|---|---|---|
| | FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TREGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | |
| G259I | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAIALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 59 |
| G259L | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRALALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEWWTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFA | 60 |
| G259M | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAMA1AGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFA | 61 |

TABLE 3-continued

T7 RNA Polymerase Variants

| T7 RNA Polymerase Variants | Amino Acid Sequence | SEQ ID NO |
|---|---|---|
| G259K | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAKALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFA | 62 |
| G259Q | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAQALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 63 |
| G259E | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAEALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 64 |
| A260I | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGILAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT | 65 |

TABLE 3-continued

T7 RNA Polymerase Variants

| T7 RNA Polymerase Variants | Amino Acid Sequence | SEQ ID NO |
|---|---|---|
| | IPADAANLFKAVRETMVDTYESCDVLADFYDQFADQLHESQLDKMPALPAK<br>GNLNLRDILESDFAFA | |
| A260L | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGLLAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 66 |
| A260M | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGMLAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 67 |
| A260K | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGKLAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 68 |
| A260Q | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGQLAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK | 69 |

TABLE 3-continued

T7 RNA Polymerase Variants

| T7 RNA Polymerase Variants | Amino Acid Sequence | SEQ ID NO |
|---|---|---|
| | TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| A260E | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGELAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 70 |
| L261A | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGAAAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 71 |
| L261I | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGAIAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 72 |
| L261M | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGAMAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG | 73 |

TABLE 3-continued

T7 RNA Polymerase Variants

| T7 RNA Polymerase Variants | Amino Acid Sequence | SEQ ID NO |
|---|---|---|
| | TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| L261K | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGAKAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 74 |
| L261Q | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGAQAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 75 |
| L261E | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGAEAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 76 |
| A262I | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALIGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC | 77 |

TABLE 3-continued

T7 RNA Polymerase Variants

| T7 RNA Polymerase Variants | Amino Acid Sequence | SEQ ID NO |
|---|---|---|
| | FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| A262L | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALLGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 78 |
| A262M | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALMGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 79 |
| A262K | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALKGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 80 |
| A262Q | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALQGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF | 81 |

TABLE 3-continued

T7 RNA Polymerase Variants

| T7 RNA Polymerase Variants | Amino Acid Sequence | SEQ ID NO |
|---|---|---|
| | ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| A262E | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLRQNAGVVGQDSETIELAPEYAEAIA<br>TRAGALEGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 82 |
| S43R | MNTINIAKNDFSDIELAAIPFNTLADHYGERLAREQLALEHERYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLRQNAGVVGQDSETIELAPEYAEAIA<br>TRAGALEGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 83 |
| E45R | MNTINIAKNDFSDIELAAIPFNTLADHYGERLAREQLALEHESYRMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLRQNAGVVGQDSETIELAPEYAEAIA<br>TRAGALEGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 84 |
| G47R | MNTINIAKNDFSDIELAAIPFNTLADHYGERLAREQLALEHESYEMREARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLRQNAGVVGQDSETIELAPEYAEAIA<br>TRAGALEGISPMFQPCVVPPKPWTGITGGGYWANGRRPLALVRTHSKKALM | 85 |

TABLE 3-continued

T7 RNA Polymerase Variants

| T7 RNA Polymerase Variants | Amino Acid Sequence | SEQ ID NO |
|---|---|---|
| | RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| R257W | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TWAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 86 |
| G259R | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRARALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 87 |
| A260R | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGRLAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 88 |
| N165W | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKWVEEQLNKRVGHVYKKAFMQVVEADMLSKGLLGGEAWSSW | 89 |

TABLE 3-continued

T7 RNA Polymerase Variants

| T7 RNA Polymerase Variants | Amino Acid Sequence | SEQ ID NO |
|---|---|---|
| | HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | |
| E167M | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVMEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 90 |
| E167N | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVNEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 91 |
| E168I | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEIQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPEC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNEVHSQDGSHLRKTVVWAHEKYGIESEALIHDSFGT<br>IPADAANLFKAVRETMVDTYESCDVLADFYDQFADQLHESQLDKMPALPAK<br>GNLNLRDILESDFAFA | 92 |
| E168T | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA | 93 |

TABLE 3-continued

T7 RNA Polymerase Variants

| T7 RNA Polymerase Variants | Amino Acid Sequence | SEQ ID NO |
|---|---|---|
| | FQFLQEIKPEAVAYITIKTTLACLTSADNTTVQAVASAIGRAIEDEARFGR IRDLEAKHFKKNVETQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | |
| E168V | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEVQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 94 |
| A181F | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKFFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 95 |
| A181W | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKWFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 96 |

TABLE 3-continued

T7 RNA Polymerase Variants

| T7 RNA Polymerase Variants | Amino Acid Sequence | SEQ ID NO |
|---|---|---|
| Q184M | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMMVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 97 |
| E187F | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVFADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFA | 98 |

TABLE 4

T7 RNA Polymerase C-Terminal Variants

| T7 RNA Polymerase C-Terminal Variant | Amino Acid Sequence | SEQ ID NO |
|---|---|---|
| S43A C-Terminal Variant | MNTINIAKNDFSDIELAAIPFNTLADHYGERLAREQLALEHEAYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 107 |
| S43A C-Terminal Variant (S43A C-terminal G | MNTINIAKNDFSDIELAAIPFNTLADHYGERLAREQLALEHEAYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW | 108 |

TABLE 4-continued

T7 RNA Polymerase C-Terminal Variants

| T7 RNA Polymerase C-Terminal Variant | Amino Acid Sequence | SEQ ID NO |
|---|---|---|
| Variant or S43A*) | HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | |
| G47A C-Terminal Variant | MNTINIAKNDFSDIELAAIPFNTLADHYGERLAREQLALEHESYEMAEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 109 |
| G47A C-Terminal Variant (G47A C-terminal G Variant or G47A*) | MNTINIAKNDFSDIELAAIPENTLADHYGERLAREQLALEHESYEMAEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 110 |
| R257A C-Terminal Variant | MNTINIAKNDFSDIELAAIPENTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TAAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 111 |

TABLE 4-continued

T7 RNA Polymerase C-Terminal Variants

| T7 RNA Polymerase C-Terminal Variant | Amino Acid Sequence | SEQ ID NO |
|---|---|---|
| R257A C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TAAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 112 |
| G259A C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAAALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 113 |
| G259A C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAAALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 114 |
| E42A C-Terminal Variant | MNTINIAKNDFSDIELAAIPFNTLADHYGERLAREQLALEHASYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK | 115 |

TABLE 4-continued

T7 RNA Polymerase C-Terminal Variants

| T7 RNA Polymerase C-Terminal Variant | Amino Acid Sequence | SEQ ID NO |
|---|---|---|
| | TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| E42A C-Terminal Variant | MNTINIAKNDFSDIELAAIPFNTLADHYGERLAREQLALEHASYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 116 |
| E42I C-Terminal Variant | MNTINIAKNDFSDIELAAIPFNTLADHYGERLAREQLALEHISYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 117 |
| E42I C-Terminal Variant | MNTINIAKNDFSDIELAAIPFNTLADHYGERLAREQLALEHISYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 118 |
| E42L C-Terminal Variant | MNTINIAKNDFSDIELAAIPFNTLADHYGERLAREQLALEHLSYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW | 119 |

TABLE 4-continued

T7 RNA Polymerase C-Terminal Variants

| T7 RNA Polymerase C-Terminal Variant | Amino Acid Sequence | SEQ ID NO |
|---|---|---|
| | LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | |
| E42L C-Terminal Variant | MNTINIAKNDFSDIELAAIPFNTLADHYGERLAREQLALEHLSYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 120 |
| E42M C-Terminal Variant | MNTINIAKNDFSDIELAAIPFNTLADHYGERLAREQLALEHMSYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 121 |
| E42M C-Terminal Variant | MNTINIAKNDFSDIELAAIPFNTLADHYGERLAREQLALEHMSYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 122 |
| E42K C-Terminal Variant | MNTINIAKNDFSDIELAAIPFNTLADHYGERLAREQLALEHKSYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW | 123 |

TABLE 4-continued

T7 RNA Polymerase C-Terminal Variants

| T7 RNA Polymerase C-Terminal Variant | Amino Acid Sequence | SEQ ID NO |
|---|---|---|
| | HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| E42K C-Terminal Variant | MNTINIAKNDFSDIELAAIPFNTLADHYGERLAREQLALEHKSYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 124 |
| E42Q C-Terminal Variant | MNTINIAKNDFSDIELAAIPFNTLADHYGERLAREQLALEHQSYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 125 |
| E42Q C-Terminal Variant | MNTINIAKNDFSDIELAAIPFNTLADHYGERLAREQLALEHQSYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 126 |

TABLE 4-continued

T7 RNA Polymerase C-Terminal Variants

| T7 RNA Polymerase C-Terminal Variant | Amino Acid Sequence | SEQ ID NO |
|---|---|---|
| S43I C-Terminal Variant | MNTINIAKNDFSDIELAAIPFNTLADHYGERLAREQLALEHEIYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 127 |
| S43I C-Terminal Variant | MNTINIAKNDFSDIELAAIPFNTLADHYGERLAREQLALEHEIYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 128 |
| S43L C-Terminal Variant | MNTINIAKNDFSDIELAAIPFNTLADHYGERLAREQLALEHELYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 129 |
| S43L C-Terminal Variant | MNTINIAKNDFSDIELAAIPFNTLADHYGERLAREQLALEHELYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK | 130 |

TABLE 4-continued

T7 RNA Polymerase C-Terminal Variants

| T7 RNA Polymerase C-Terminal Variant | Amino Acid Sequence | SEQ ID NO |
|---|---|---|
| | GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | |
| S43M C-Terminal Variant | MNTINIAKNDFSDIELAAIPENTLADHYGERLAREQLALEHEMYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 131 |
| S43M C-Terminal Variant | MNTINIAKNDFSDIELAAIPENTLADHYGERLAREQLALEHEMYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 132 |
| S43K C-Terminal Variant | MNTINIAKNDFSDIELAAIPFNTLADHYGERLAREQLALEHEKYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 133 |
| S43K C-Terminal Variant | MNTINIAKNDFSDIELAAIPFNTLADHYGERLAREQLALEHEKYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF | 134 |

TABLE 4-continued

T7 RNA Polymerase C-Terminal Variants

| T7 RNA Polymerase C-Terminal Variant | Amino Acid Sequence | SEQ ID NO |
|---|---|---|
| | ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| S43Q C-Terminal Variant | MNTINIAKNDFSDIELAAIPFNTLADHYGERLAREQLALEHEQYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 135 |
| S43Q C-Terminal Variant | MNTINIAKNDFSDIELAAIPENTLADHYGERLAREQLALEHEQYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 136 |
| S43E C-Terminal Variant | MNTINIAKNDFSDIELAAIPENTLADHYGERLAREQLALEHEEYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 137 |
| S43E C-Terminal Variant | MNTINIAKNDFSDIELAAIPENTLADHYGERLAREQLALEHEEYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR | 138 |

TABLE 4-continued

T7 RNA Polymerase C-Terminal Variants

| T7 RNA Polymerase C-Terminal Variant | Amino Acid Sequence | SEQ ID NO |
|---|---|---|
| | IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| Y44A C-Terminal Variant | MNTINIAKNDFSDIELAAIPENTLADHYGERLAREQLALEHESAEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 139 |
| Y44A C-Terminal Variant | MNTINIAKNDFSDIELAAIPENTLADHYGERLAREQLALEHESAEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 140 |
| Y44I C-Terminal Variant | MNTINIAKNDFSDIELAAIPENTLADHYGERLAREQLALEHESIEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT | 141 |

TABLE 4-continued

T7 RNA Polymerase C-Terminal Variants

| T7 RNA Polymerase C-Terminal Variant | Amino Acid Sequence | SEQ ID NO |
|---|---|---|
| | IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| Y44I C-Terminal Variant | MNTINIAKNDFSDIELAAIPFNTLADHYGERLAREQLALEHESIEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 142 |
| Y44L C-Terminal Variant | MNTINIAKNDFSDIELAAIPFNTLADHYGERLAREQLALEHESLEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 143 |
| Y44L C-Terminal Variant | MNTINIAKNDFSDIELAAIPFNTLADHYGERLAREQLALEHESLEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 144 |
| Y44M C-Terminal Variant | MNTINIAKNDFSDIELAAIPFNTLADHYGERLAREQLALEHESMEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL | 145 |

TABLE 4-continued

T7 RNA Polymerase C-Terminal Variants

| T7 RNA Polymerase C-Terminal Variant | Amino Acid Sequence | SEQ ID NO |
|---|---|---|
| | LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFA$X_n$, where X is any amino acid and n is any integer, e.g., between 1 and 5 | |
| Y44M C-Terminal Variant | MNTINIAKNDFSDIELAAIPFNTLADHYGERLAREQLALEHESMEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 146 |
| Y44K C-Terminal Variant | MNTINIAKNDFSDIELAAIPFNTLADHYGERLAREQLALEHESKEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFA$X_n$, where X is any amino acid and n is any integer, e.g., between 1 and 5 | 147 |
| Y44K C-Terminal Variant | MNTINIAKNDFSDIELAAIPFNTLADHYGERLAREQLALEHESKEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 148 |
| Y44Q C-Terminal Variant | MNTINIAKNDFSDIELAAIPFNTLADHYGERLAREQLALEHESQEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM | 149 |

TABLE 4-continued

T7 RNA Polymerase C-Terminal Variants

| T7 RNA Polymerase C-Terminal Variant | Amino Acid Sequence | SEQ ID NO |
|---|---|---|
| | RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| Y44Q C-Terminal Variant | MNTINIAKNDFSDIELAAIPFNTLADHYGERLAREQLALEHESQEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 150 |
| Y44E C-Terminal Variant | MNTINIAKNDFSDIELAAIPFNTLADHYGERLAREQLALEHESEEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 151 |
| Y44E C-Terminal Variant | MNTINIAKNDFSDIELAAIPFNTLADHYGERLAREQLALEHESEEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 152 |

TABLE 4-continued

T7 RNA Polymerase C-Terminal Variants

| T7 RNA Polymerase C-Terminal Variant | Amino Acid Sequence | SEQ ID NO |
|---|---|---|
| E45A C-Terminal Variant | MNTINIAKNDFSDIELAAIPFNTLADHYGERLAREQLALEHESYAMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFX$_n$, where X is any amino acid and n is any integer, e.g., between 1 and 5 | 153 |
| E45A C-Terminal Variant | MNTINIAKNDFSDIELAAIPFNTLADHYGERLAREQLALEHESYAMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 154 |
| E45I C-Terminal Variant | MNTINIAKNDFSDIELAAIPFNTLADHYGERLAREQLALEHESYIMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFX$_n$, where X is any amino acid and n is any integer, e.g., between 1 and 5 | 155 |
| E45I C-Terminal Variant | MNTINIAKNDFSDIELAAIPFNTLADHYGERLAREQLALEHESYIMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK | 156 |

TABLE 4-continued

T7 RNA Polymerase C-Terminal Variants

| T7 RNA Polymerase C-Terminal Variant | Amino Acid Sequence | SEQ ID NO |
|---|---|---|
| | GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| E45L C-Terminal Variant | MNTINIAKNDFSDIELAAIPFNTLADHYGERLAREQLALEHESYLMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 157 |
| E45L C-Terminal Variant | MNTINIAKNDFSDIELAAIPFNTLADHYGERLAREQLALEHESYLMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 158 |
| E45M C-Terminal Variant | MNTINIAKNDFSDIELAAIPFNTLADHYGERLAREQLALEHESYMMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 159 |
| E45M C-Terminal Variant | MNTINIAKNDFSDIELAAIPFNTLADHYGERLAREQLALEHESYMMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF | 160 |

TABLE 4-continued

T7 RNA Polymerase C-Terminal Variants

| T7 RNA Polymerase C-Terminal Variant | Amino Acid Sequence | SEQ ID NO |
|---|---|---|
| | ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| E45K C-Terminal Variant | MNTINIAKNDFSDIELAAIPFNTLADHYGERLAREQLALEHESYKMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 161 |
| E45K C-Terminal Variant | MNTINIAKNDFSDIELAAIPFNTLADHYGERLAREQLALEHESYKMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 162 |
| E45Q C-Terminal Variant | MNTINIAKNDFSDIELAAIPENTLADHYGERLAREQLALEHESYQMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 163 |
| E45Q C-Terminal Variant | MNTINIAKNDFSDIELAAIPENTLADHYGERLAREQLALEHESYQMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR | 164 |

TABLE 4-continued

T7 RNA Polymerase C-Terminal Variants

| T7 RNA Polymerase C-Terminal Variant | Amino Acid Sequence | SEQ ID NO |
|---|---|---|
| | IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| M46A C-Terminal Variant | MNTINIAKNDFSDIELAAIPFNTLADHYGERLAREQLALEHESYEAGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFA$X_n$, where X is any amino acid and n is any integer, e.g., between 1 and 5 | 165 |
| M46A C-Terminal Variant | MNTINIAKNDFSDIELAAIPFNTLADHYGERLAREQLALEHESYEAGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 166 |
| M46I C-Terminal Variant | MNTINIAKNDFSDIELAAIPFNTLADHYGERLAREQLALEHESYEIGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT | 167 |

TABLE 4-continued

T7 RNA Polymerase C-Terminal Variants

| T7 RNA Polymerase C-Terminal Variant | Amino Acid Sequence | SEQ ID NO |
|---|---|---|
| | IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| M46I C-Terminal Variant | MNTINIAKNDFSDIELAAIPFNTLADHYGERLAREQLALEHESYEIGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 168 |
| M46L C-Terminal Variant | MNTINIAKNDFSDIELAAIPFNTLADHYGERLAREQLALEHESYELGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 169 |
| M46L C-Terminal Variant | MNTINIAKNDFSDIELAAIPFNTLADHYGERLAREQLALEHESYELGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 170 |
| M46K C-Terminal Variant | MNTINIAKNDFSDIELAAIPFNTLADHYGERLAREQLALEHESYEKGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL | 173 |

TABLE 4-continued

T7 RNA Polymerase C-Terminal Variants

| T7 RNA Polymerase C-Terminal Variant | Amino Acid Sequence | SEQ ID NO |
|---|---|---|
| | LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | |
| M46K C-Terminal Variant | MNTINIAKNDFSDIELAAIPENTLADHYGERLAREQLALEHESYEKGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 174 |
| M46Q C-Terminal Variant | MNTINIAKNDFSDIELAAIPENTLADHYGERLAREQLALEHESYEQGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 175 |
| M46Q C-Terminal Variant | MNTINIAKNDFSDIELAAIPENTLADHYGERLAREQLALEHESYEQGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 176 |
| M46E C-Terminal Variant | MNTINIAKNDFSDIELAAIPFNTLADHYGERLAREQLALEHESYEEGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALAGISPMFQPCVVPPKPWTGITGGGYWANGRRPLALVRTHSKKALM | 177 |

TABLE 4-continued

T7 RNA Polymerase C-Terminal Variants

| T7 RNA Polymerase C-Terminal Variant | Amino Acid Sequence | SEQ ID NO |
|---|---|---|
| | RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| M46E C-Terminal Variant | MNTINIAKNDFSDIELAAIPFNTLADHYGERLAREQLALEHESYEEGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 178 |
| G47I C-Terminal Variant | MNTINIAKNDFSDIELAAIPFNTLADHYGERLAREQLALEHESYEMIEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 179 |
| G47I C-Terminal Variant | MNTINIAKNDFSDIELAAIPFNTLADHYGERLAREQLALEHESYEMIEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 180 |

TABLE 4-continued

T7 RNA Polymerase C-Terminal Variants

| T7 RNA Polymerase C-Terminal Variant | Amino Acid Sequence | SEQ ID NO |
|---|---|---|
| G47L C-Terminal Variant | MNTINIAKNDFSDIELAAIPFNTLADHYGERLAREQLALEHESYEMLEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 181 |
| G47L C-Terminal Variant | MNTINIAKNDFSDIELAAIPFNTLADHYGERLAREQLALEHESYEMLEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 182 |
| G47M C-Terminal Variant | MNTINIAKNDFSDIELAAIPFNTLADHYGERLAREQLALEHESYEMMEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 183 |
| G47M C-Terminal Variant | MNTINIAKNDFSDIELAAIPFNTLADHYGERLAREQLALEHESYEMMEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK | 184 |

TABLE 4-continued

T7 RNA Polymerase C-Terminal Variants

| T7 RNA Polymerase C-Terminal Variant | Amino Acid Sequence | SEQ ID NO |
|---|---|---|
| | GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| G47K C-Terminal Variant | MNTINIAKNDFSDIELAAIPENTLADHYGERLAREQLALEHESYEMKEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 185 |
| G47K C-Terminal Variant | MNTINIAKNDFSDIELAAIPENTLADHYGERLAREQLALEHESYEMKEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 186 |
| G47Q C-Terminal Variant | MNTINIAKNDFSDIELAAIPENTLADHYGERLAREQLALEHESYEMQEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAXn, where X is any amino acid and n is any integer, e.g., between 1 and 5 | 187 |
| G47Q C-Terminal Variant | MNTINIAKNDFSDIELAAIPENTLADHYGERLAREQLALEHESYEMQEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF | 188 |

TABLE 4-continued

T7 RNA Polymerase C-Terminal Variants

| T7 RNA Polymerase C-Terminal Variant | Amino Acid Sequence | SEQ ID NO |
|---|---|---|
| | ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| G47E C-Terminal Variant | MNTINIAKNDFSDIELAAIPENTLADHYGERLAREQLALEHESYEMEEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 189 |
| G47E C-Terminal Variant | MNTINIAKNDFSDIELAAIPFNTLADHYGERLAREQLALEHESYEMEEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 190 |
| R257I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TIAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 191 |
| R257I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR | 192 |

TABLE 4-continued

T7 RNA Polymerase C-Terminal Variants

| T7 RNA Polymerase C-Terminal Variant | Amino Acid Sequence | SEQ ID NO |
|---|---|---|
| | IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TIAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| R257L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TLAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 193 |
| R257L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TLAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 194 |
| R257M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TMAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT | 195 |

TABLE 4-continued

T7 RNA Polymerase C-Terminal Variants

| T7 RNA Polymerase C-Terminal Variant | Amino Acid Sequence | SEQ ID NO |
|---|---|---|
| | IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| R257M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TMAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 196 |
| R257K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TKAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 197 |
| R257K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TKAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 198 |
| R257Q C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TQAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL | 199 |

TABLE 4-continued

T7 RNA Polymerase C-Terminal Variants

| T7 RNA Polymerase C-Terminal Variant | Amino Acid Sequence | SEQ ID NO |
|---|---|---|
| | LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | |
| R257Q C-Terminal Variant | MNTINIAKNDFSDIELAAIPENTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TQAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 200 |
| R257E C-Terminal Variant | MNTINIAKNDFSDIELAAIPENTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TEAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 201 |
| R257E C-Terminal Variant | MNTINIAKNDFSDIELAAIPENTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TEAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 202 |
| A258I C-Terminal Variant | MNTINIAKNDFSDIELAAIPENTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRIGALAGISPMFQPCVVPPKPWTGITGGGYWANGRRPLALVRTHSKKALM | 203 |

TABLE 4-continued

T7 RNA Polymerase C-Terminal Variants

| T7 RNA Polymerase C-Terminal Variant | Amino Acid Sequence | SEQ ID NO |
|---|---|---|
| | RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| A258I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRIGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 204 |
| A258L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRLGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 205 |
| A258L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRLGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 206 |

TABLE 4-continued

T7 RNA Polymerase C-Terminal Variants

| T7 RNA Polymerase C-Terminal Variant | Amino Acid Sequence | SEQ ID NO |
|---|---|---|
| A258M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRMGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 207 |
| A258M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRMGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 208 |
| A258K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRKGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 209 |
| A258K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRKGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK | 210 |

TABLE 4-continued

T7 RNA Polymerase C-Terminal Variants

| T7 RNA Polymerase C-Terminal Variant | Amino Acid Sequence | SEQ ID NO |
|---|---|---|
| | GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| A258Q C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRQGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 211 |
| A258Q C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRQGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 212 |
| A258E C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TREGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 213 |
| A258E C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TREGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF | 214 |

TABLE 4-continued

T7 RNA Polymerase C-Terminal Variants

| T7 RNA Polymerase C-Terminal Variant | Amino Acid Sequence | SEQ ID NO |
|---|---|---|
| | ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| G259I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAIALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 215 |
| G259I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAIALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 216 |
| G259L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRALALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 217 |
| G259L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR | 218 |

TABLE 4-continued

T7 RNA Polymerase C-Terminal Variants

| T7 RNA Polymerase C-Terminal Variant | Amino Acid Sequence | SEQ ID NO |
|---|---|---|
| | IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRALALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| G259M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAMALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 219 |
| G259M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAMALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 220 |
| G259K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAKALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT | 221 |

TABLE 4-continued

T7 RNA Polymerase C-Terminal Variants

| T7 RNA Polymerase C-Terminal Variant | Amino Acid Sequence | SEQ ID NO |
|---|---|---|
| | IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| G259K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAKALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 222 |
| G259Q C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAQALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 223 |
| G259Q C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAQALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 224 |
| G259E C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAEALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL | 225 |

TABLE 4-continued

T7 RNA Polymerase C-Terminal Variants

| T7 RNA Polymerase C-Terminal Variant | Amino Acid Sequence | SEQ ID NO |
|---|---|---|
| | LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | |
| G259E C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAEALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 226 |
| A260I C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGILAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 227 |
| A260I C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGILAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 228 |
| A260L C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGLLAGISPMFQPCVVPPKPWTGITGGGYWANGRRPLALVRTHSKKALM | 229 |

TABLE 4-continued

T7 RNA Polymerase C-Terminal Variants

| T7 RNA Polymerase C-Terminal Variant | Amino Acid Sequence | SEQ ID NO |
|---|---|---|
| | RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| A260L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGLLAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 230 |
| A260M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGMLAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 231 |
| A260M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGMLAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 232 |

TABLE 4-continued

T7 RNA Polymerase C-Terminal Variants

| T7 RNA Polymerase C-Terminal Variant | Amino Acid Sequence | SEQ ID NO |
|---|---|---|
| A260K C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGKLAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 233 |
| A260K C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGKLAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 234 |
| A260Q C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGQLAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 235 |
| A260Q C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGQLAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK | 236 |

TABLE 4-continued

T7 RNA Polymerase C-Terminal Variants

| T7 RNA Polymerase C-Terminal Variant | Amino Acid Sequence | SEQ ID NO |
|---|---|---|
| | GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| A260E C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGELAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 237 |
| A260E C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGELAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 238 |
| L261A C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAAAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 37 |
| L261A C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAAAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF | 239 |

TABLE 4-continued

T7 RNA Polymerase C-Terminal Variants

| T7 RNA Polymerase C-Terminal Variant | Amino Acid Sequence | SEQ ID NO |
|---|---|---|
| | ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| L261I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAIAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 240 |
| L261I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAIAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 241 |
| L261M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAMAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 242 |
| L261M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR | 243 |

TABLE 4-continued

T7 RNA Polymerase C-Terminal Variants

| T7 RNA Polymerase C-Terminal Variant | Amino Acid Sequence | SEQ ID NO |
|---|---|---|
| | IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAMAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| L261K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAKAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 244 |
| L261K C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAKAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 245 |
| L261Q C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAQAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT | 246 |

TABLE 4-continued

T7 RNA Polymerase C-Terminal Variants

| T7 RNA Polymerase C-Terminal Variant | Amino Acid Sequence | SEQ ID NO |
|---|---|---|
| | IPADAANLFKAVRETMVDTYESCDVLADFYDQFADQLHESQLDKMPALPAK GNLNLRDILESDFAFAX$_n$,, where X is any amino acid and n is any integer, e.g., between 1 and 5 | |
| L261Q C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAQAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 247 |
| L261E C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAEAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$,, where X is any amino acid and n is any integer, e.g., between 1 and 5 | 248 |
| L261E C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGAEAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 249 |
| A262I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALIGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL | 250 |

TABLE 4-continued

T7 RNA Polymerase C-Terminal Variants

| T7 RNA Polymerase C-Terminal Variant | Amino Acid Sequence | SEQ ID NO |
|---|---|---|
| | LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFA$X_n$, where X is any amino acid and n is any integer, e.g., between 1 and 5 | |
| A262I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALIGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 251 |
| A262L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALLGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFA$X_n$, where X is any amino acid and n is any integer, e.g., between 1 and 5 | 252 |
| A262L C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALLGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 253 |
| A262M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALMGISPMFQPCVVPPKPWTGITGGGYWANGRRPLALVRTHSKKALM | 254 |

TABLE 4-continued

T7 RNA Polymerase C-Terminal Variants

| T7 RNA Polymerase C-Terminal Variant | Amino Acid Sequence | SEQ ID NO |
|---|---|---|
| | RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| A262M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALMGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 255 |
| A262K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALKGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 256 |
| A262K C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALKGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 257 |

TABLE 4-continued

T7 RNA Polymerase C-Terminal Variants

| T7 RNA Polymerase C-Terminal Variant | Amino Acid Sequence | SEQ ID NO |
|---|---|---|
| A262Q C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALQGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 258 |
| A262Q C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALQGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 259 |
| A262E C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALEGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAX$_n$, where X is any amino acid and n is any integer, e.g., between 1 and 5 | 260 |
| A262E C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGALEGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK | 261 |

TABLE 4-continued

T7 RNA Polymerase C-Terminal Variants

| T7 RNA Polymerase C-Terminal Variant | Amino Acid Sequence | SEQ ID NO |
|---|---|---|
| | GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| S43R C-Terminal Variant | MNTINIAKNDFSDIELAAIPFNTLADHYGERLAREQLALEHERYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 262 |
| S43R C-Terminal Variant | MNTINIAKNDFSDIELAAIPFNTLADHYGERLAREQLALEHERYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 263 |
| E45R C-Terminal Variant | MNTINIAKNDFSDIELAAIPFNTLADHYGERLAREQLALEHESYRMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 264 |
| E45R C-Terminal Variant | MNTINIAKNDFSDIELAAIPFNTLADHYGERLAREQLALEHESYRMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF | 265 |

TABLE 4-continued

T7 RNA Polymerase C-Terminal Variants

| T7 RNA Polymerase C-Terminal Variant | Amino Acid Sequence | SEQ ID NO |
|---|---|---|
| | ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| G47R C-Terminal Variant | MNTINIAKNDFSDIELAAIPENTLADHYGERLAREQLALEHESYEMREARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 266 |
| G47R C-Terminal Variant | MNTINIAKNDFSDIELAAIPENTLADHYGERLAREQLALEHESYEMREARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 267 |
| R257W C-terminal variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TWAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 268 |
| R257W C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR | 269 |

TABLE 4-continued

T7 RNA Polymerase C-Terminal Variants

| T7 RNA Polymerase C-Terminal Variant | Amino Acid Sequence | SEQ ID NO |
|---|---|---|
| | IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TWAGALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | |
| G259R C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRARALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFA$X_n$, where X is any amino acid and n is any integer, e.g., between 1 and 5 | 270 |
| G259R C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRARALAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT<br>IPADAANLFKAVRETMVDTYESCDVLADFYDQFADQLHESQLDKMPALPAK<br>GNLNLRDILESDFAFAG | 271 |
| A260R C-Terminal Variant | MNTINIAKNDFSDIELAAIPFNTLADHYGERLAREQLALEHESYEMGEARF<br>RKMFERQLKAGEVADNAAAKPLITTLLPKMIARINDWFEEVKAKRGKRPTA<br>FQFLQEIKPEAVAYITIKTTLACLTSADNTTVQAVASAIGRAIEDEARFGR<br>IRDLEAKHFKKNVEEQLNKRVGHVYKKAFMQVVEADMLSKGLLGGEAWSSW<br>HKEDSIHVGVRCIEMLIESTGMVSLHRQNAGVVGQDSETIELAPEYAEAIA<br>TRAGRLAGISPMFQPCVVPPKPWTGITGGGYWANGRRPLALVRTHSKKALM<br>RYEDVYMPEVYKAINIAQNTAWKINKKVLAVANVITKWKHCPVEDIPAIER<br>EELPMKPEDIDMNPEALTAWKRAAAAVYRKDKARKSRRISLEFMLEQANKF<br>ANHKAIWFPYNMDWRGRVYAVSMFNPQGNDMTKGLLTLAKGKPIGKEGYYW<br>LKIHGANCAGVDKVPFPERIKFIEENHENIMACAKSPLENTWWAEQDSPFC<br>FLAFCFEYAGVQHHGLSYNCSLPLAFDGSCSGIQHFSAMLRDEVGGRAVNL<br>LPSETVQDIYGIVAKKVNEILQADAINGTDNEVVTVTDENTGEISEKVKLG<br>TKALAGQWLAYGVTRSVTKRSVMTLAYGSKEFGFRQQVLEDTIQPAIDSGK<br>GLMFTQPNQAAGYMAKLIWESVSVTVVAAVEAMNWLKSAAKLLAAEVKDKK<br>TGEILRKRCAVHWVTPDGFPVWQEYKKPIQTRLNLMFLGQFRLQPTINTNK<br>DSEIDAHKQESGIAPNFVHSQDGSHLRKTVVWAHEKYGIESFALIHDSFGT | 272 |

TABLE 4-continued

T7 RNA Polymerase C-Terminal Variants

| T7 RNA Polymerase C-Terminal Variant | Amino Acid Sequence | SEQ ID NO |
|---|---|---|
| | IPADAANLFKAVRETMVDTYESCDVLADFYDQFADQLHESQLDKMPALPAK GNLNLRDILESDFAFAX$_n$,, where X is any amino acid and n is any integer, e.g., between 1 and 5 | |
| A260R C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGRLAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 273 |
| N165W C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKWVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$,, where X is any amino acid and n is any integer, e.g., between 1 and 5 | 274 |
| N165W C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKWVEEQLNKRVGHVYKKAFMQVVEADMLSKGLLGGEAWSSW HKEDSIHVGVRCIEMLIESTGMVSLHRQNAGVVGQDSETIELAPEYAEAIA TRAALAGISPMFQPCVVPPKPWTGITGGGYWANGRRPLALVRTHSKKALMR YEDVYMPEVYKAINIAQNTAWKINKKVLAVANVITKWKHCPVEDIPAIERE ELPMKPEDIDMNPEALTAWKRAAAAVYRKDKARKSRRISLEFMLEQANKFA NHKAIWFPYNMDWRGRVYAVSMFNPQGNDMTKGLLTLAKGKPIGKEGYYWL KIHGANCAGVDKVPFPERIKFIEENHENIMACAKSPLENTWWAEQDSPFCF LAFCFEYAGVQHHGLSYNCSLPLAFDGSCSGIQHFSAMLRDEVGGRAVNLL PSETVQDIYGIVAKKVNEILQADAINGTDNEVVTVTDENTGEISEKVKLGT KALAGQWLAYGVTRSVTKRSVMTLAYGSKEFGFRQQVLEDTIQPAIDSGKG LMFTQPNQAAGYMAKLIWESVSVTVVAAVEAMNWLKSAAKLLAAEVKDKKT GEILRKRCAVHWVTPDGFPVWQEYKKPIQTRLNLMFLGQFRLQPTINTNKD SEIDAHKQESGIAPNFVHSQDGSHLRKTVVWAHEKYGIESFALIHDSFGTI PADAANLFKAVRETMVDTYESCDVLADFYDQFADQLHESQLDKMPALPAKG NLNLRDILESDFAFAG | 275 |
| E167M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVMEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL | 276 |

TABLE 4-continued

T7 RNA Polymerase C-Terminal Variants

| T7 RNA Polymerase C-Terminal Variant | Amino Acid Sequence | SEQ ID NO |
|---|---|---|
| | LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| E167M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVMEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 277 |
| E167N C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVNEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 278 |
| E167N C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVNEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 279 |
| E168I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEIQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM | 280 |

TABLE 4-continued

T7 RNA Polymerase C-Terminal Variants

| T7 RNA Polymerase C-Terminal Variant | Amino Acid Sequence | SEQ ID NO |
|---|---|---|
| | RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | |
| E168I C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEIQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 281 |
| E168T C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVETQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 282 |
| E168T C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVETQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 283 |

TABLE 4-continued

T7 RNA Polymerase C-Terminal Variants

| T7 RNA Polymerase C-Terminal Variant | Amino Acid Sequence | SEQ ID NO |
|---|---|---|
| E168V C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEVQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 284 |
| E168V C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEVQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 285 |
| A181F C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKFFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 286 |
| A181F C-Terminal Variant | MNTINIAKNDFSDIELAAIPENTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKFFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK | 287 |

TABLE 4-continued

T7 RNA Polymerase C-Terminal Variants

| T7 RNA Polymerase C-Terminal Variant | Amino Acid Sequence | SEQ ID NO |
|---|---|---|
| | GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| A181W C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKWFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 288 |
| A181W C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKWFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 289 |
| Q184M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMMVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 290 |
| Q184M C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMMVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF | 291 |

TABLE 4-continued

T7 RNA Polymerase C-Terminal Variants

| T7 RNA Polymerase C-Terminal Variant | Amino Acid Sequence | SEQ ID NO |
|---|---|---|
| | ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | |
| E187F C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVFADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAX$_n$, where X is any amino acid and n is any integer, e.g., between 1 and 5 | 292 |
| E187F C-Terminal Variant | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVFADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPFC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNFVHSQDGSHLRKTVVWAHEKYGIESFALIHDSFGT IPADAANLFKAVRETMVDTYESCDVLADFYDQFADQLHESQLDKMPALPAK GNLNLRDILESDFAFAG | 293 |
| T7 RNA Polymerase C-Terminal Variant (C-terminal GG) | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFAGG | 294 |
| T7 RNA Polymerase C-Terminal (C-terminal A) | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW | 295 |

TABLE 4-continued

T7 RNA Polymerase C-Terminal Variants

| T7 RNA Polymerase C-Terminal Variant | Amino Acid Sequence | SEQ ID NO |
|---|---|---|
| | HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFAA | |
| T7 RNA Polymerase C-Terminal Variant (C-terminal AA) | MNTINIAKNDFSDIELAAIPFNTLADHYGERLAREQLALEHESYEMGEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFAAA | 296 |
| G47A C-Terminal Variant (C-terminal GG) | MNTINIAKNDFSDIELAAIPFNTLADHYGERLAREQLALEHESYEMAEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFAGG | 297 |
| G47A C-Terminal Variant (C-terminal A) | MNTINIAKNDFSDIELAAIPFNTLADHYGERLAREQLALEHESYEMAEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFAA | 298 |

TABLE 4-continued

T7 RNA Polymerase C-Terminal Variants

| T7 RNA Polymerase C-Terminal Variant | Amino Acid Sequence | SEQ ID NO |
|---|---|---|
| G47A C-Terminal Variant (C-terminal AA) | MNTINIAKNDFSDIELAAIPFNTLADHYGERLAREQLALEHESYEMAEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFAA | 299 |
| S43A/G47A | MNTINIAKNDFSDIELAAIPENTLADHYGERLAREQLALEHEAYEMAEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFA | 300 |
| S43A/G47A C-Terminal Variant (C-terminal G) | MNTINIAKNDFSDIELAAIPENTLADHYGERLAREQLALEHEAYEMAEARF RKMFERQLKAGEVADNAAAKPLITTLLPKMIARINDWFEEVKAKRGKRPTA FQFLQEIKPEAVAYITIKTTLACLTSADNTTVQAVASAIGRAIEDEARFGR IRDLEAKHFKKNVEEQLNKRVGHVYKKAFMQVVEADMLSKGLLGGEAWSSW HKEDSIHVGVRCIEMLIESTGMVSLHRQNAGVVGQDSETIELAPEYAEAIA TRAGALAGISPMFQPCVVPPKPWTGITGGGYWANGRRPLALVRTHSKKALM RYEDVYMPEVYKAINIAQNTAWKINKKVLAVANVITKWKHCPVEDIPAIER EELPMKPEDIDMNPEALTAWKRAAAAVYRKDKARKSRRISLEFMLEQANKF ANHKAIWFPYNMDWRGRVYAVSMFNPQGNDMTKGLLTLAKGKPIGKEGYYW LKIHGANCAGVDKVPFPERIKFIEENHENIMACAKSPLENTWWAEQDSPEC FLAFCFEYAGVQHHGLSYNCSLPLAFDGSCSGIQHFSAMLRDEVGGRAVNL LPSETVQDIYGIVAKKVNEILQADAINGTDNEVVTVTDENTGEISEKVKLG TKALAGQWLAYGVTRSVTKRSVMTLAYGSKEFGFRQQVLEDTIQPAIDSGK GLMFTQPNQAAGYMAKLIWESVSVTVVAAVEAMNWLKSAAKLLAAEVKDKK TGEILRKRCAVHWVTPDGFPVWQEYKKPIQTRLNLMFLGQFRLQPTINTNK DSEIDAHKQESGIAPNEVHSQDGSHLRKTVVWAHEKYGIESEALIHDSFGT IPADAANLFKAVRETMVDTYESCDVLADFYDQFADQLHESQLDKMPALPAK GNLNLRDILESDFAFAG | 301 |

Example 2. The Purity of hEPO mRNA Produced Using the T7 RNA Polymerase Variants is Comparable to the Purity of hEPO mRNA Produced Using a Wild-Type T7 RNA Polymerase In vitro transcription reactions were performed using hEPO DNA template and (1) Wild-type (WT) T7 RNA polymerase (WT #1 and WT #2), (2) a G47A C-terminal G T7 RNA polymerase variant ("G47A*") (SEQ ID NO: 110), and (3) a S43A C-terminal G T7 RNA polymerase variant ("S43A*") (SEQ ID NO: 108). DBAA (dibutylammonium acetate) HPLC analyses showed that the purity of all hEPO transcripts was approximately the same (FIG. 1).

Figure 2:
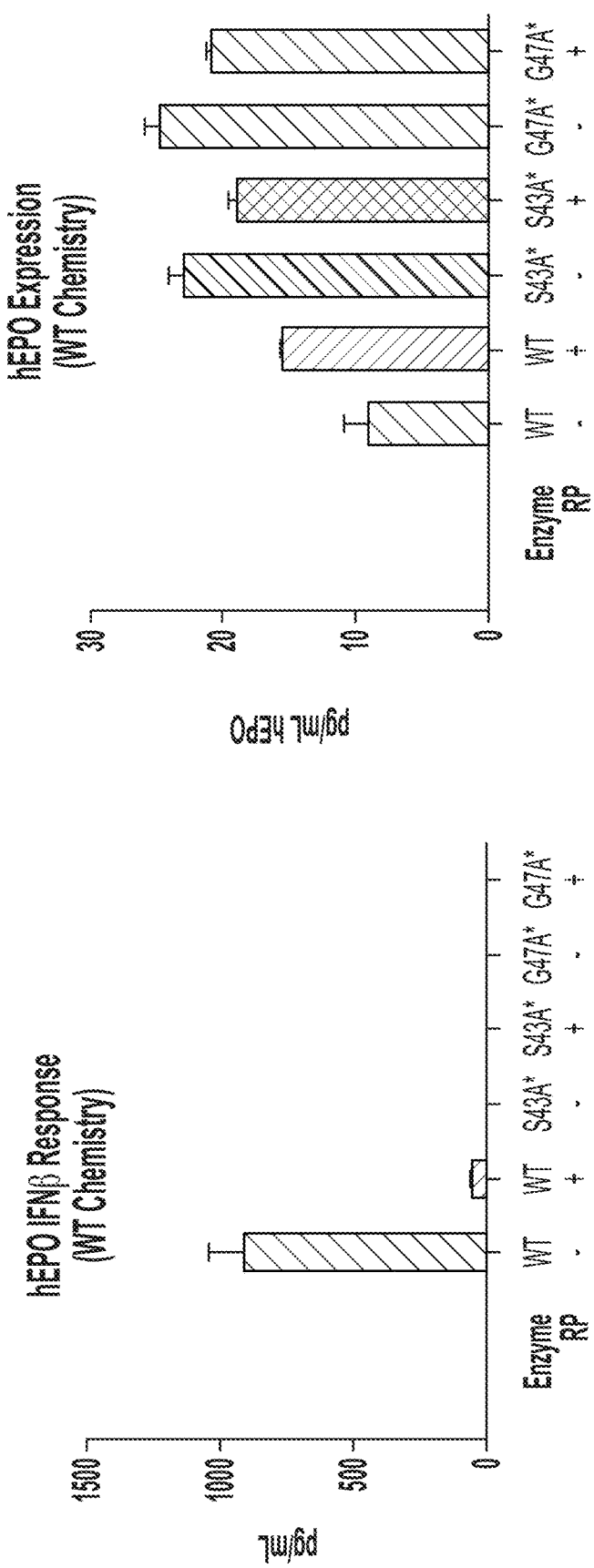
FIG. 2, left panel, shows a graph depicting IFNβ response in BJ fibroblasts transfected with chemically-unmodified hEPO RNA transcript produced using WT T7 RNA polymerase or one of the T7 RNA polymerase variants, S43A* (with C-terminal G) or G47A* (with C-terminal G), with or without reverse phase (RP) purification.

Example 3. hEPO mRNA Produced Using the T7 RNA Polymerase Variants does not Elicit a Cellular Cytokine Response BJ fibroblasts were transfected with hEPO mRNA produced by the IVT reactions described in Example 2. The mRNA was either unpurified or purified by reverse phase (RP) chromatography. As shown in FIG. 2 (left graph), unpurified mRNA produced using the S43A* T7 RNA polymerase variant or the G47A* T7 RNA polymerase variant was as 'cold' (did not elicit a cytokine response) as purified mRNA produced using WT T7 polymerase. Approximately equivalent mRNA expression levels are shown in FIG. 2 (right graph). The mRNA used in these experiments did not contain any nucleotide modifications.

Figure 3:
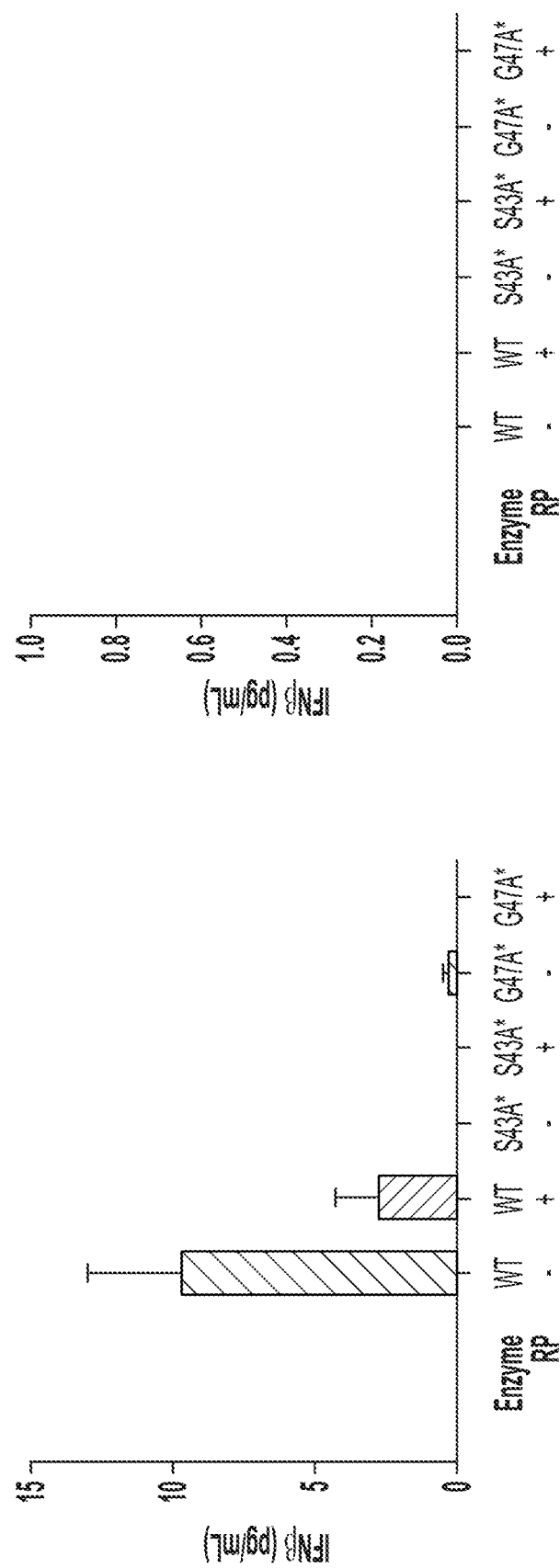
FIG. 3, left graph, shows a depiction of IFNβ response in BJ fibroblasts transfected with chemically-modified hEPO RNA transcripts (N1-methylpseudouracil ($m^1\psi$) modifications) produced using WT T7 RNA polymerase or one of the T7 RNA polymerase variants, S43A* (with C-terminal G) or G47A* (with C-terminal G), with or without reverse phase (RP) purification.
Figure 4:
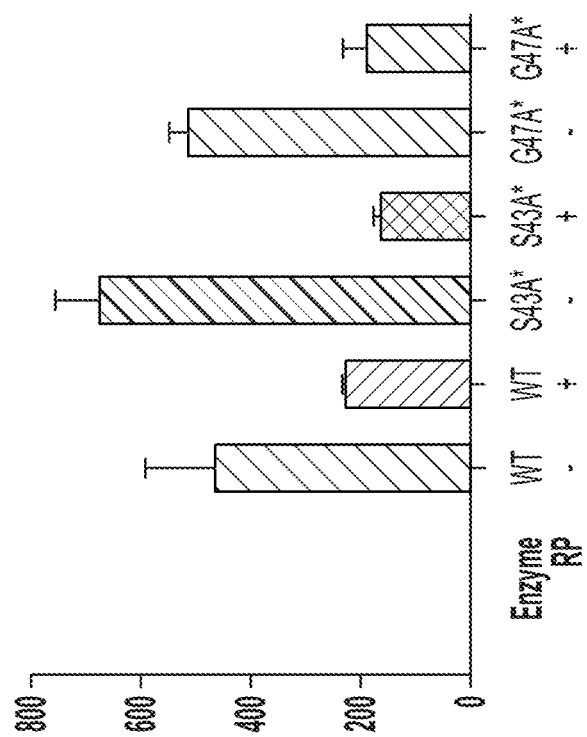
FIG. 4 shows graphs depicting hEPO expression in cells transfected with the hEPO RNA transcripts used for FIG. 3. N1-methylpseudouracil ($m^1\psi$) modified hEPO expression is on the left, and 5-methoxy-uridine ($mo^5U$) modified hEPO expression is shown on the right.
Figure 4:
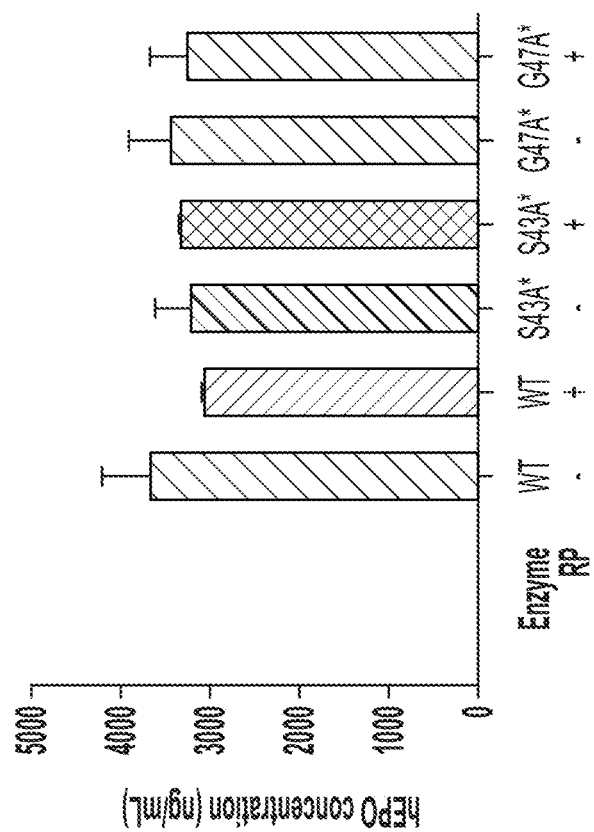

A similar cell transfection assay was repeated using hEPO mRNA containing either $m^1\psi$ nucleotide modifications (FIG. 3, top graph) or $mo^5U$ nucleotide modifications (FIG. 3, bottom graph). BJ fibroblast cells transfected with unpurified $m^1\psi$ hEPO mRNA produced using the G47A* and S43A* T7 RNA polymerase variants exhibited lower IFNβ responses than cells transfected with unpurified $m^1\psi$ hEPO mRNA produced using WT T7 RNA polymerase. Approximately equivalent mRNA expression levels are shown in FIG. 4.

Figure 5:
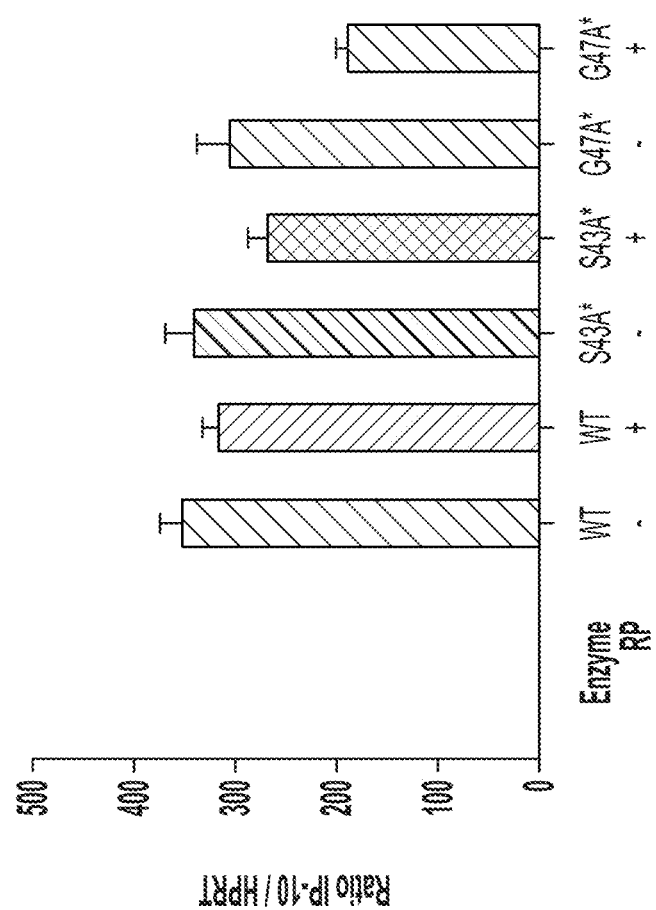
FIG. 5 shows a graph of IP10 response in monocyte-derived macrophages transfected with chemically-unmodified hEPO RNA transcript produced using WT T7 RNA polymerase or T7 RNA polymerase variants, S43A* (with C-terminal G) or G47A* (with C-terminal G).
Figure 6:
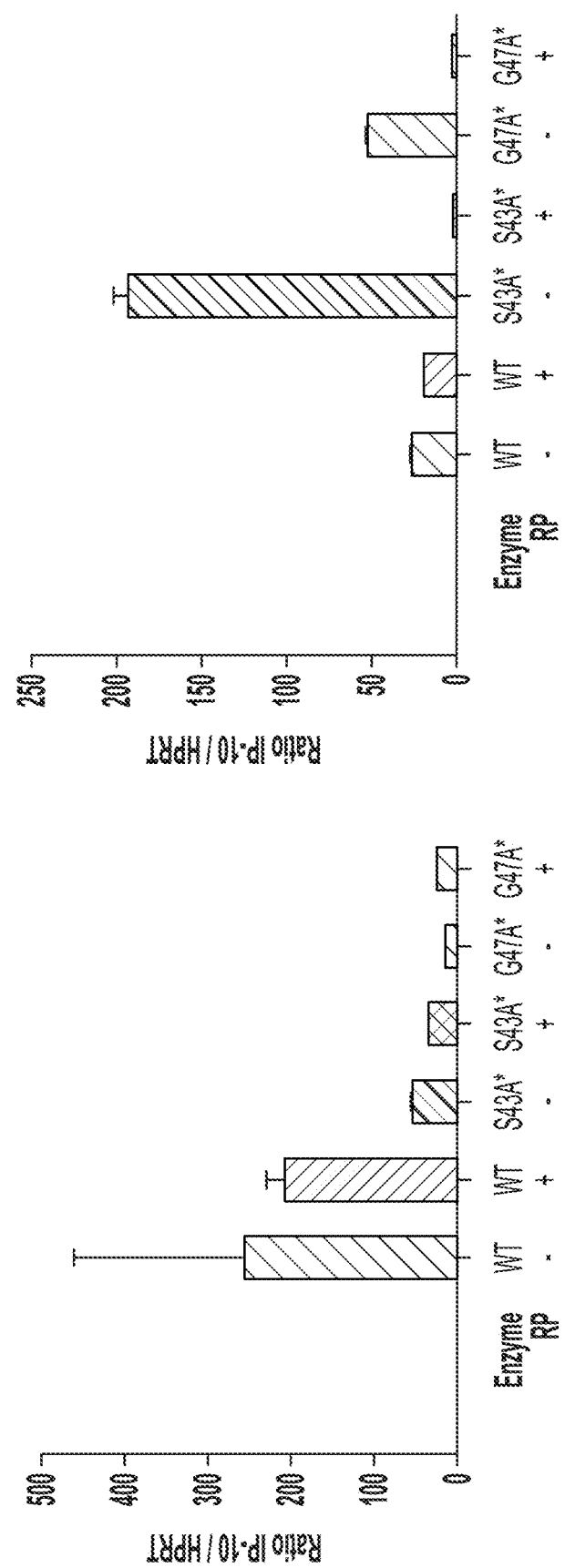
FIG. 6, left graph, shows the IP10 response in monocyte-derived macrophages transfected with chemically-modified (N1-methylpseudouracil ($m^1\psi$)) hEPO RNA transcript produced using WT T7 RNA polymerase or T7 RNA polymerase variants, S43A* (with C-terminal G) or G47A* (with C-terminal G).

Monocyte-derived macrophages (MDMs) were then used to examine cytokine response further. An IP10 to hypoxanthine-guanine phosophoribosyltransferase (HPRT) ratio was measured in MDMs transfected with hEPO mRNA generated under the conditions described in Example 2. MDMs are very sensitive to the unmodified chemistry, so drastic differences between samples were not seen using unmodified hEPO mRNA. However, MDMs transfected with unpurified $m^1\psi$ hEPO mRNA produced using the G47A* and S43A* T7 RNA polymerase variants exhibited lower IP10 responses than MDMs transfected with purified $m^1\psi$ hEPO mRNA produced using WT T7 RNA polymerase (FIG. 5, top graph).

Figure 7:
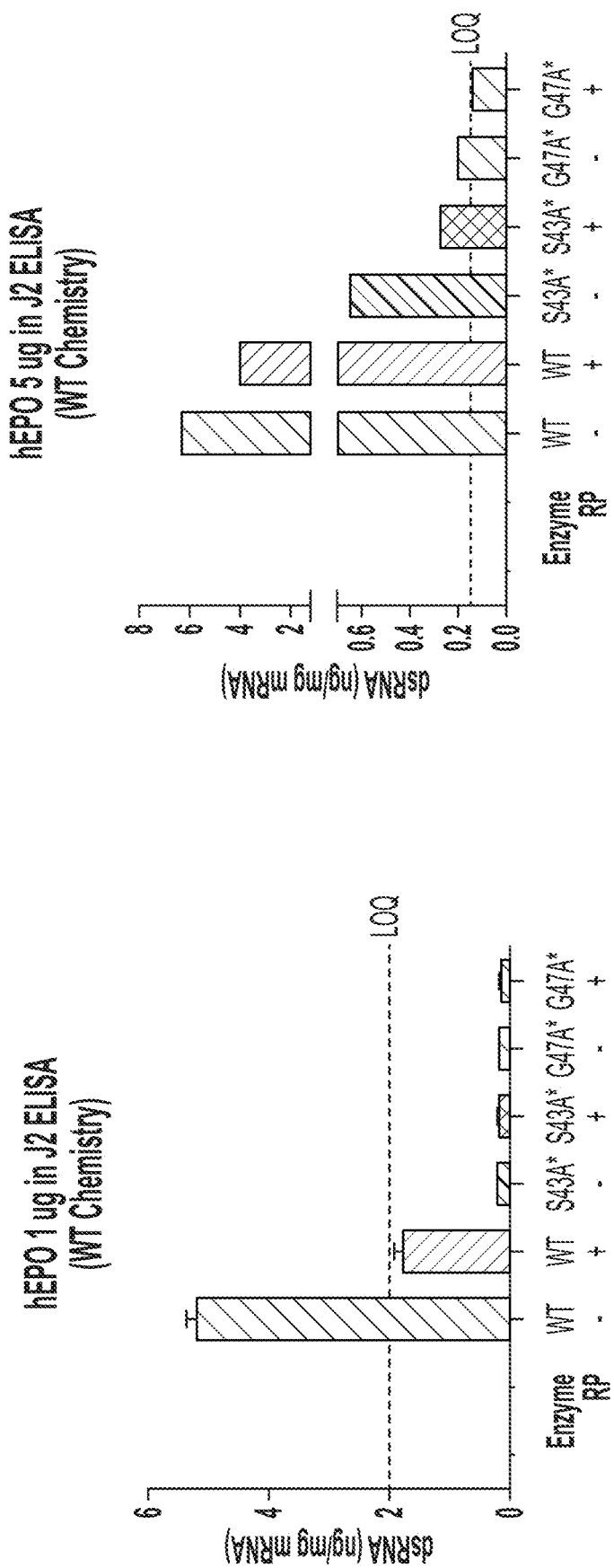
FIG. 7 shows graphs depicting concentration of contaminating double-stranded (ds) RNA detected using a dsRNA ELISA with 1 μg of chemically-unmodified hEPO RNA transcript (left) or 5 μg chemically-unmodified hEPO RNA transcript produced via IVT reaction using WT T7 RNA polymerase or T7 RNA polymerase variants, S43A* (with C-terminal G) or G47A* (with C-terminal G).
Figure 8:
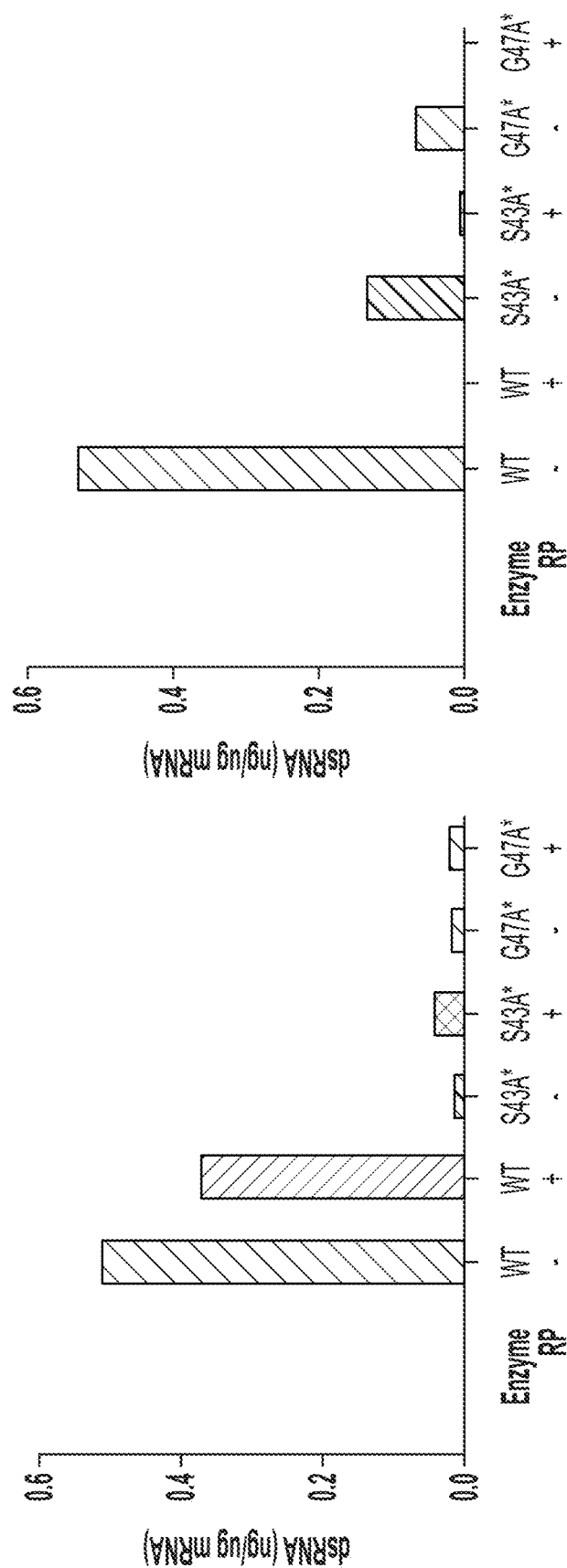
FIG. 8 shows graphs depicting concentration of contaminating dsRNA detected using a dsRNA ELISA with chemically-modified hEPO RNA transcript (N1-methylpseudouracil ($m^1\psi$) modification, left; 5-methoxy-uridine ($mo^5U$) modification, right).

Example 4. The T7 RNA Polymerase Variants Produce mRNA Associated with Less Contaminating dsRNA than the WT T7 RNA Polymerase A standard dsRNA ELISA was used to assess dsRNA contaminants (e.g., longer than 40 nucleotide base pairs) in IVT reactions used to produce unmodified hEPO mRNA (FIG. 7) or hEPO mRNA containing either $m^1\psi$ nucleotide modifications (FIG. 8, top graph) or $mo^5U$ nucleotide modifications (FIG. 8, bottom graph). The dsRNA assay demonstrated that the S43A* T7 RNA polymerase variant and the G47A* T7 RNA polymerase variant produced less dsRNA than WT T7 RNA polymerase (FIGS. 7 and 8).

Example 5. The T7 RNA Polymerase Variants Reduce 3' Heterogeneity of mRNA

Figures 9A, 9B:
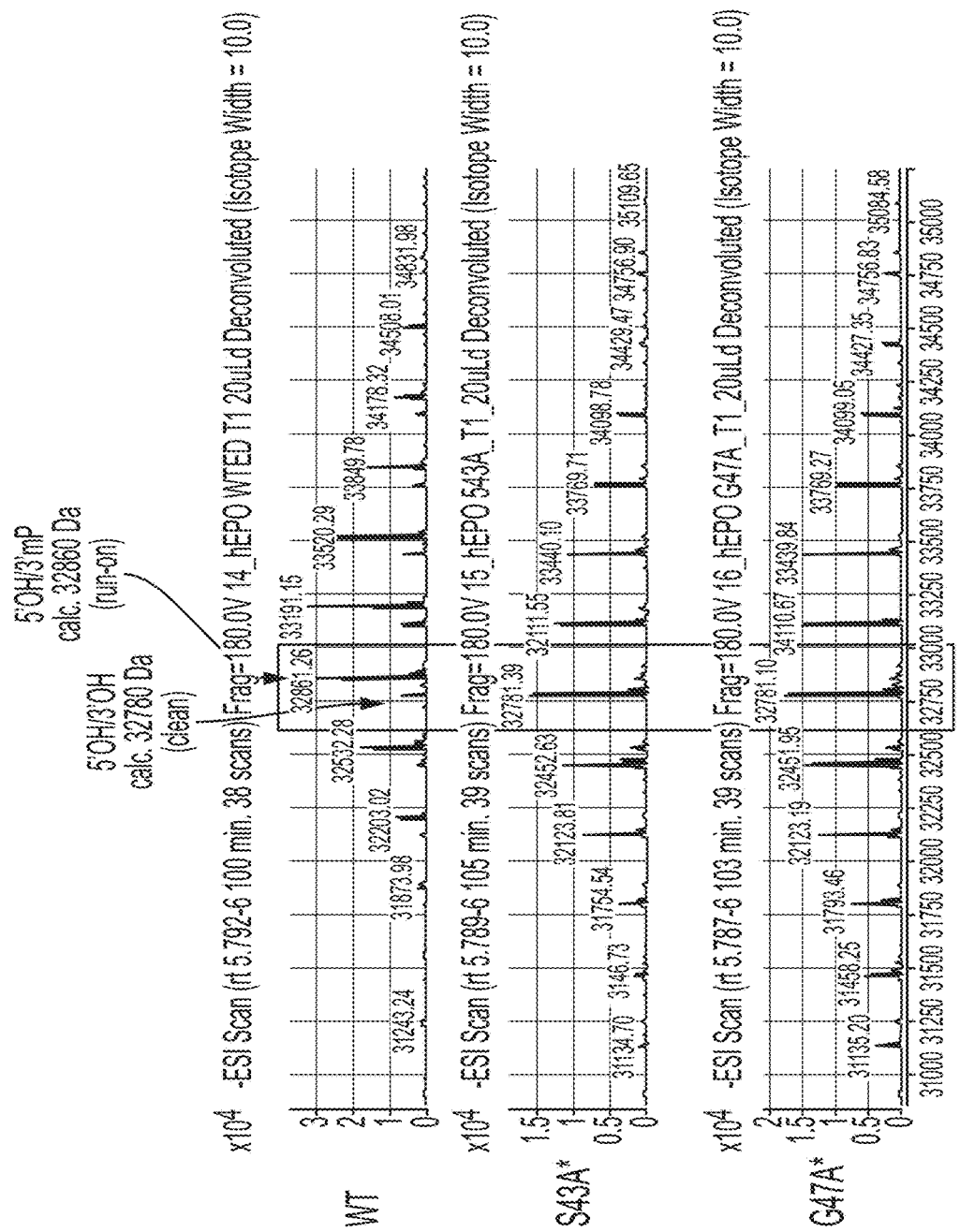
FIGS. 9A-9B show mass chromatogram results from a RNase T1 tail digest of hEPO RNA transcript produced using WT T7 RNA polymerase of T7 RNA polymerase variants, S43A* (with C-terminal G) or G47A* (with C-terminal G).
Figure 10:
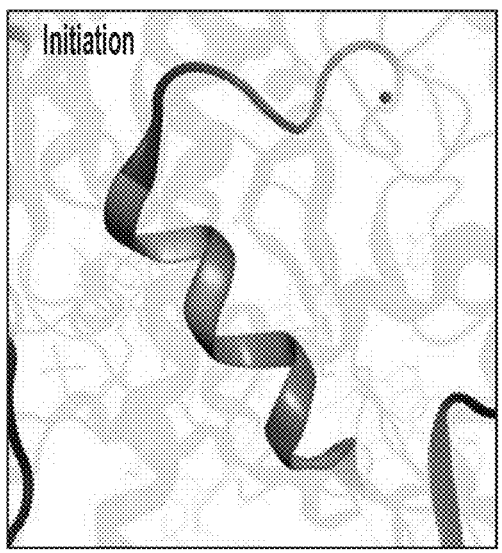
FIG. 10 shows a schematic of the C-helix and C-linker loop structures changing conformation into C-helix and C-loop helix structures as the T7 RNA polymerase transitions from the initiation complex to the elongation complex.
Figure 10:
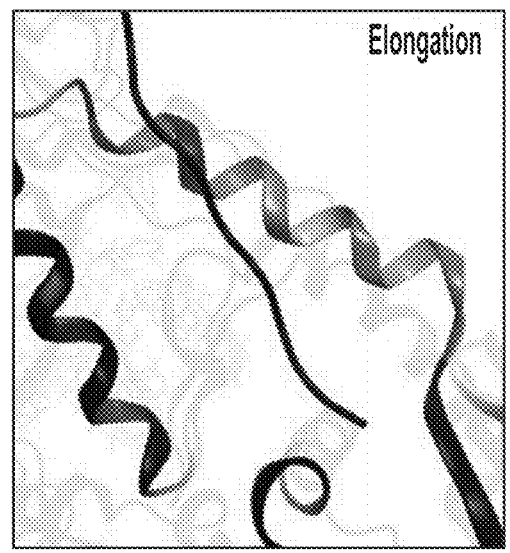
Figure 10:
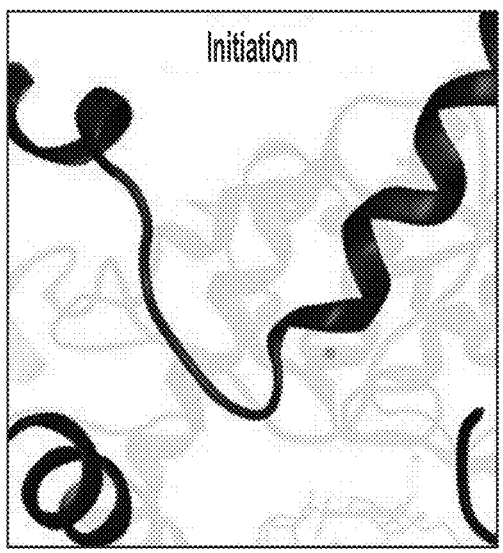
Figure 10:
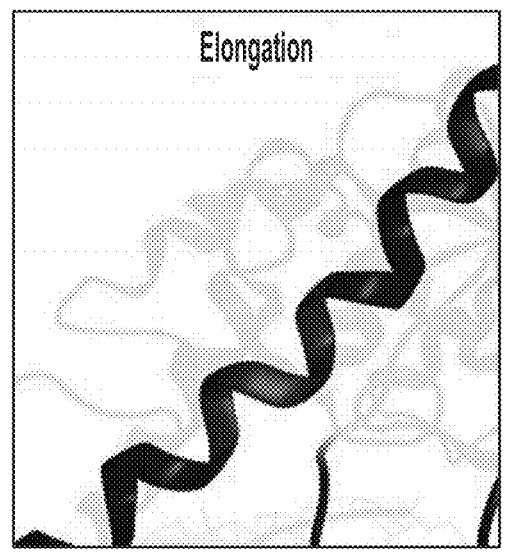

The 3' heterogeneity of transcripts can be measured using a RNAse T1 digest. RNAse T1 cleaves mRNA specifically after a G nucleotide. Endonucleolytic cleavage results in a 5' hydroxide (OH) and 3' monophosphate (mP) 'scar'. Thus, a RNAse T1 digest can be used to differentiate between transcripts that do and do not have non-templated additions at the 3' end. In this Example, the hEPO mRNA produced in Example 2 terminate with a polyA tail and a XbaI restriction site (e.g. $A_n$UCUAG). hEPO mRNA produced using WT T7 RNA polymerase, the S43A* T7 RNA polymerase variant, or the G47A* T7 RNA polymerase variant were digested with RNAse T1 and analyzed by LCMS to generate oligo fingerprints. A clean 3' end (5' OH/3' OH) was found to peak at 32780 Da, while a 'scar' (5' OH/3' mP) peaks at 32860 Da (FIG. 9A). A 'scar' indicates that the transcript had non-templated additions at the carboxy terminus. hEPO mRNA produced using the T7 RNA polymerase variants, S43A* or G47A*, had a higher 3' end population distribution, indicating that they have cleaner 3' ends and improved 3' end heterogeneity (FIG. 9B).

Example 6. T7 RNA Polymerase Variants Produce 'Cleaner' 3' Ends

Figure 11A:
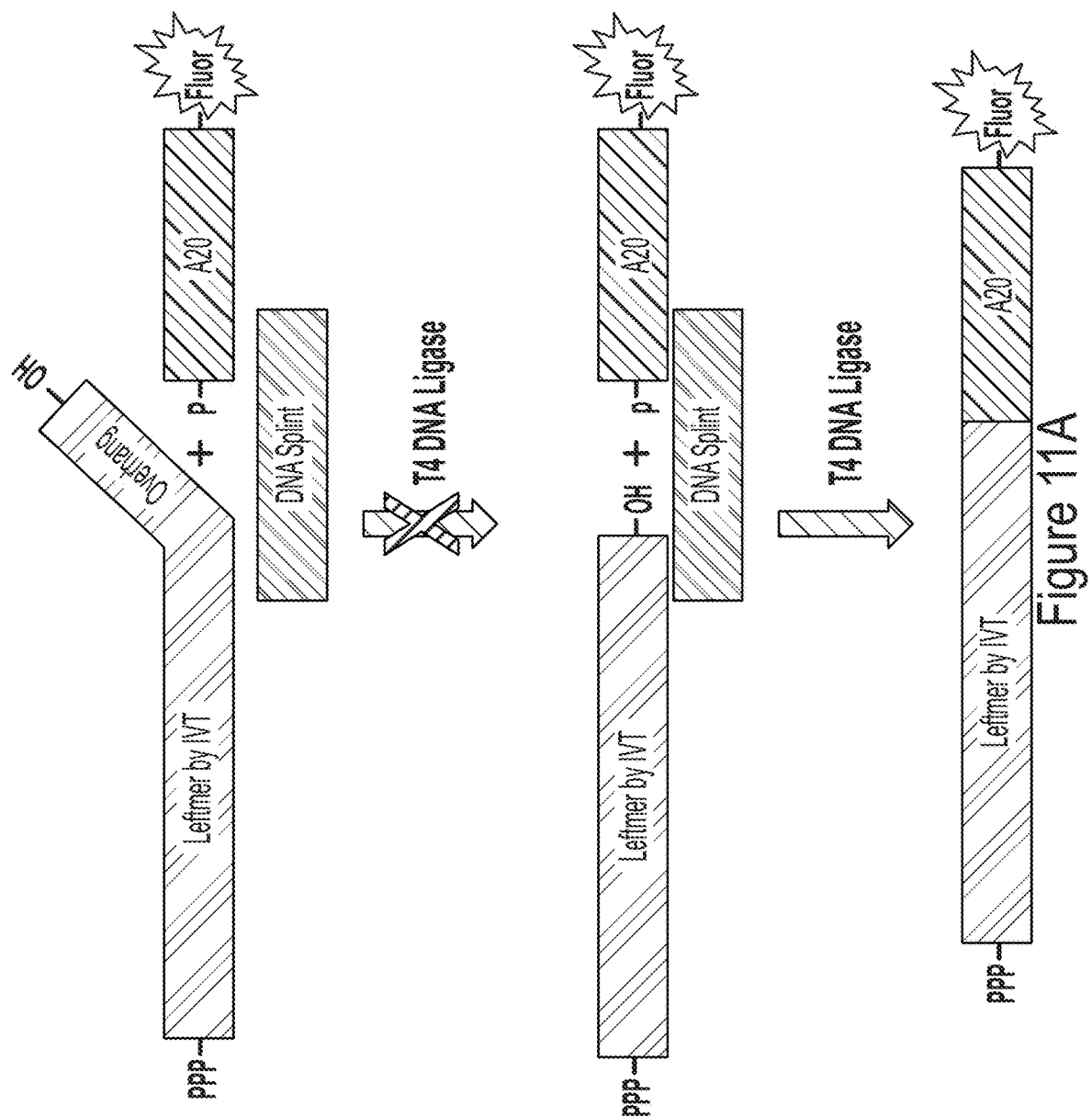
FIG. 11A shows a schematic of using a DNA splint in the present of ligase to ligate a "leftmer" RNA transcript produced by IVT to a "rightmer" fluorescently-labeled polyA signal. Even a single nucleotide overhang at the ligation site abolishes ligation efficiently.
Figure 11B:
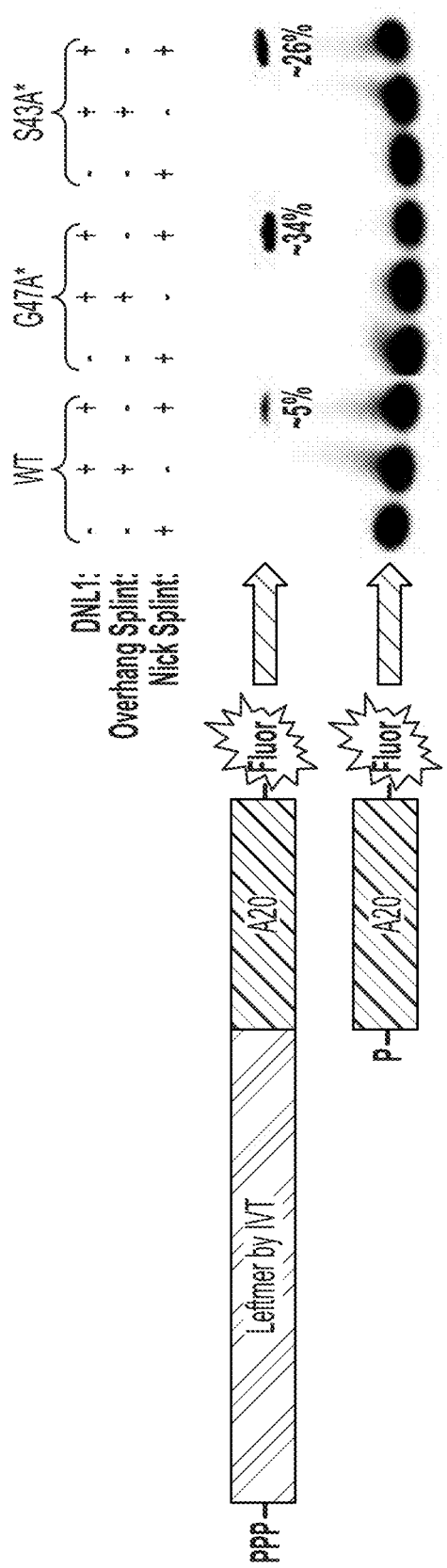
FIG. 11B is a PAGE-D gel showing ligation efficiency for rightmers produced with WT T7 RNA polymerase and T7 RNA polymerase variants, G47A* (with C-terminal G) or S43A* (with C-terminal G).
Figure 12:
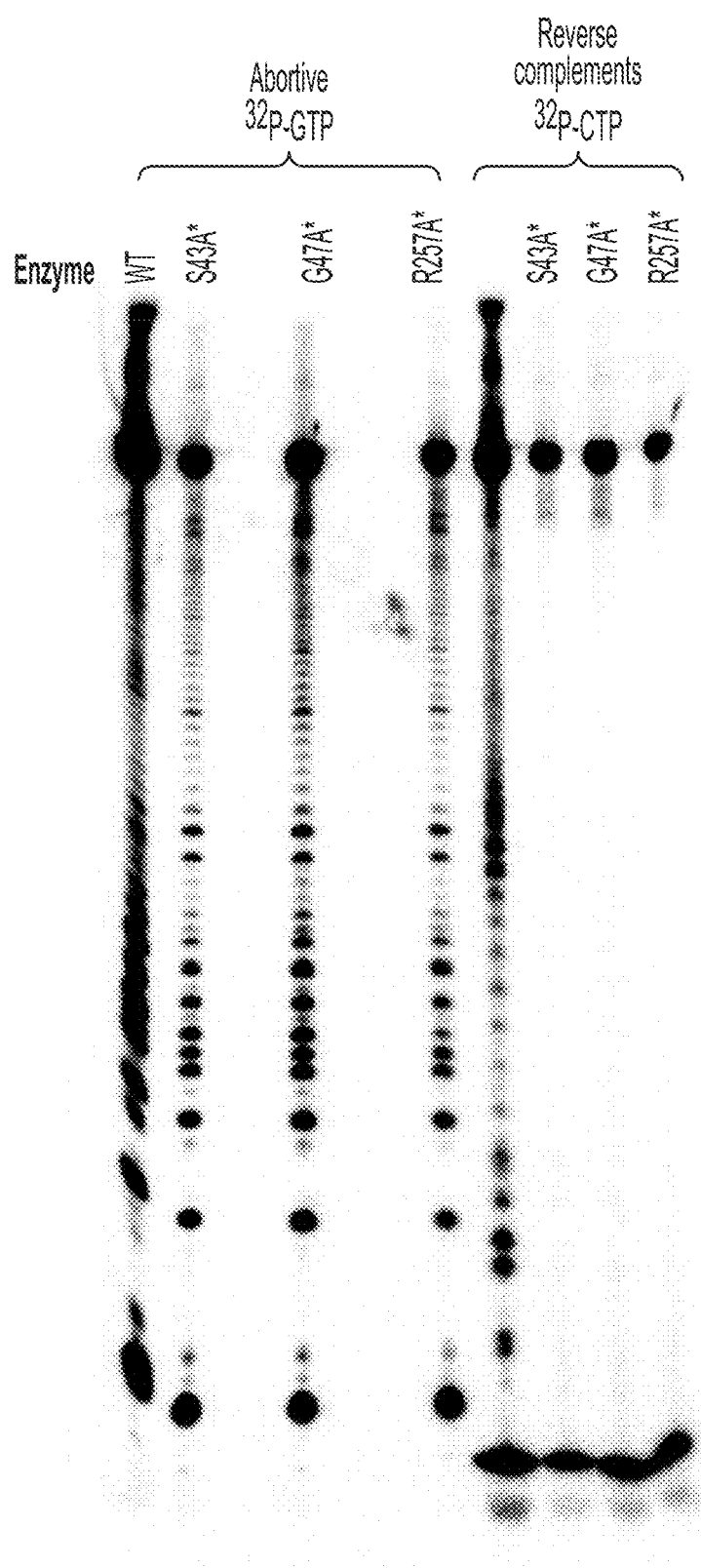
FIG. 12 shows a radioactive gel using 32P-GTP to label abortive transcripts or 32P-CTP to label reverse complements. The IVTs were performed using a short model transcript. This data demonstrates that T7 RNA polymerase variants S43A* (with C-terminal G) and G47A* (with C-terminal G) reduce reverse complement formation.

An assay was used to probe the extent of non-templated additions produced by T7 RNAP variants, G47A* and S43A*. In this assay, ligation leftmers were made using an enzymatic polymerase (see, e.g., FIG. 11A). The leftmers were then annealed to a fully-complimentary DNA splint immediately adjacent to a 5'-monophosporylated rightmer RNA. A DNA splint is typically 40 nt long and the rightmer is typically decorated with a fluorophore at the 5'-end. DNA ligase I was then added under catalytic conditions and ligation was allowed to proceed for a desired reaction time before the reaction was quenched with EDTA. The mixture was then denatured in 4M urea at 95° C. for 5 minutes before being loaded onto a denaturing polyacrylamide gel (PAGE-D) (FIG. 11B). The percentage of acrylamide in the gel depends on the length of the expected construct but is typically 6% acrylamide for leftmers >50 nt in length and 20% acrylamide for leftmers approaching the length of typical mRNA. 6% acrylamide gels ran for 25 minutes at a constant 180V and 20% acrylamide gels ran for 120 minutes at a constant 180V. The gels were then imaged on a Typhoon or similar scanner using excitation and emission wavelengths appropriate to the fluorophore present on the rightmer and the newly ligated product. Rightmer and ligated products migrate differently on the gel based upon size, and the intensity of the two bands will exactly correspond to the efficiently of the ligation reaction. The greater the extent of untemplated nucleotide addition during the enzymatic synthesis of the leftmer, the lower the expected ligation yield.

Ligation yield was calculated as a ratio of bands corresponding to unligated rightmer and ligated full-length product. The reaction was terminated early to exaggerate differences in reaction yields. Based on these results T7 RNAP variant G47A* incorporated the fewest untemplated nucleotides at the 3'-end of the leftmer RNA.

Figure 13:
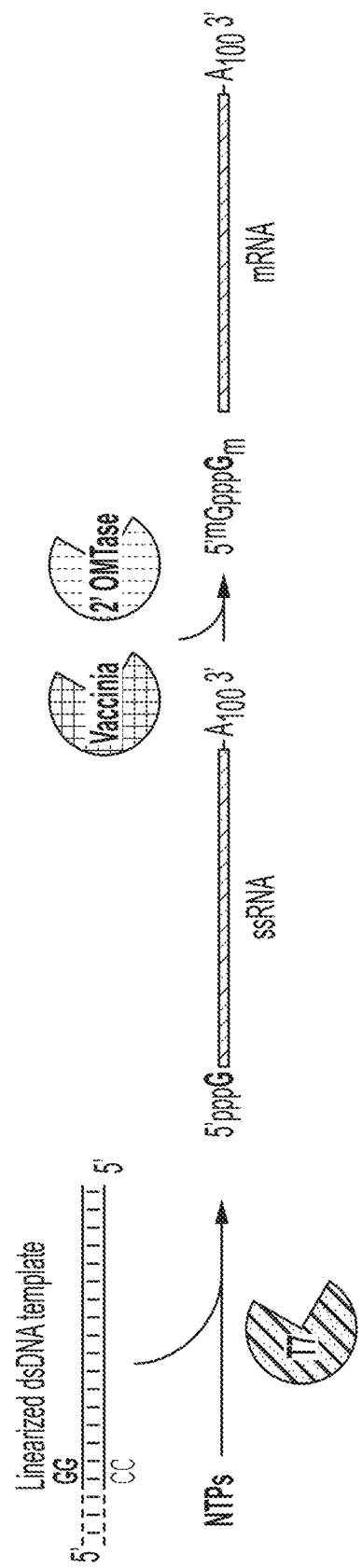
FIG. 13 is a schematic of a convention method of producing a capped mRNA via in vitro transcription.

Example 7. Production of Capped mRNAs in a Single In Vitro Transcription Reaction In a standard in vitro transcription (IVT) assay, T7 RNA polymerase prefers to initiate transcription with a 5'GTP. A single stranded RNA (ssRNA) molecule produced by such standard IVT assays requires a separate enzymatic capping step (FIG. 13). For example, a cap1 RNA (7mGpppN2'-Om-RNA) can be produced in a capping assay using a Vaccinia capping enzyme and a 2'-O-methyl transferase (2'OMTase). Cap1 is typically used for efficient protein translation and mRNA stability in cells. However, some mRNA sequences are difficult to cap, and capping/methylation enzymes are very expensive.

The present disclosure provides, in some embodiments, methods of capping a ssRNA (e.g., mRNA) with trinucleotides co-transcriptionally in an in vitro transcription assay using a T7 RNA polymerase variant described herein (e.g., T7 RNA polymerase variant G47A*). Efficient co-transcriptional capping typically includes a double-stranded DNA (dsDNA) template that initiates transcription with 5'ATP and equimolar concentrations of NTPs and trinucleotides. Normally, T7 RNA polymerase has severely reduced initiation activity with 5'ATP. However, in the presence of XAG (wherein X is any nucleotide, e.g., 5'$^{7m}$Gppp) trinucleotides, the limited initiation activity of T7 RNA polymerase with 5'ATP drives initiation with the trinucleotide rather than 5'ATP, generating capped mRNA products co-transcriptionally.

Figure 14A:
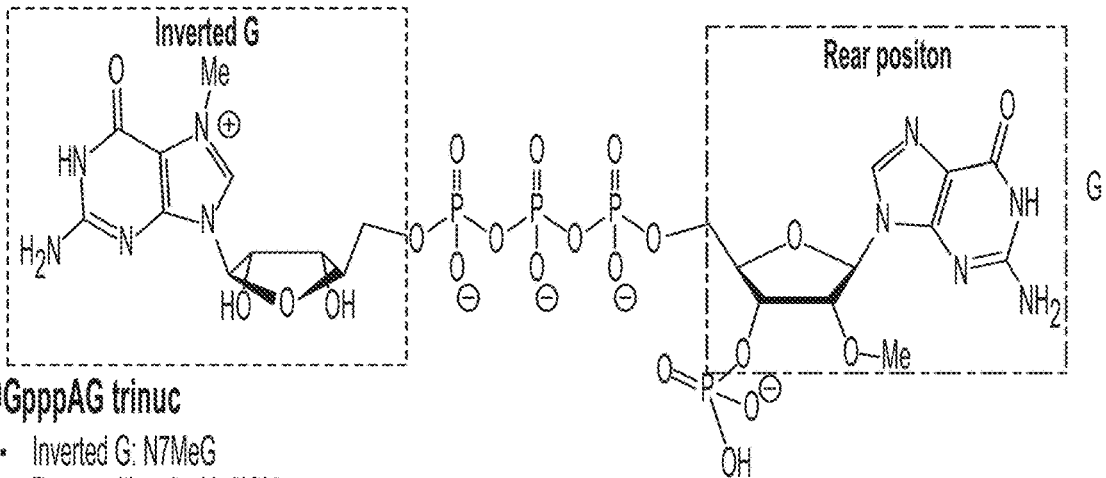
FIGS. 14A-14E are graphs showing results of a co-transcriptional capping assay using either wild-type T7 RNA polymerase or a T7 RNA polymerase variant of the present disclosure (G47A*).
Figure 14A:
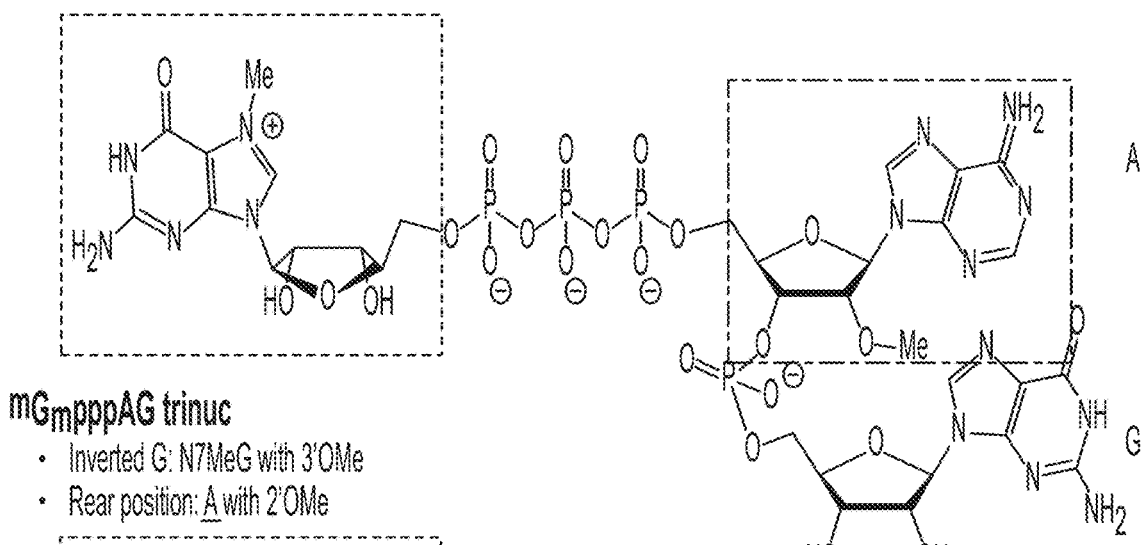
Figure 14A:
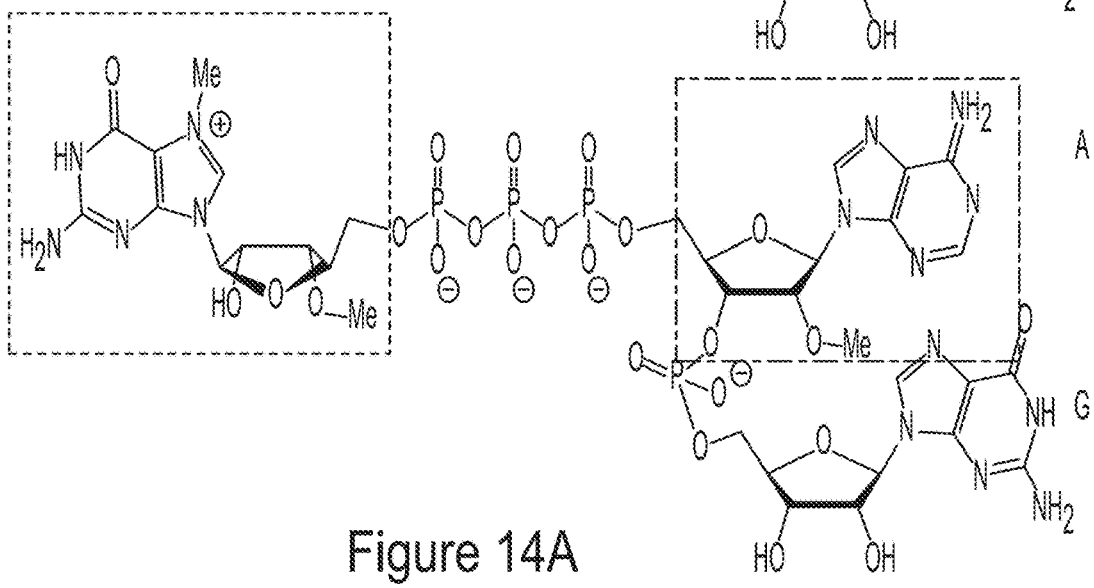

Exemplary commercially available di- and trinucleotide caps are shown in FIG. 14A. The Vaccinia cap1 is a typical di-nucleotide cap and cannot be added co-transcriptionally. Another di-nucleotide cap that can be added co-transcriptionally is the Anti-Reverse Cap Analog (ARCA), also commercially available (e.g., from Thermo Fisher, Catalog number: AM8045). ARCA is a modified cap analog in which the 3' OH group (closer to m$^7$G) is replaced with —OCH3. ARCA is used as a control in some of the co-transcriptional capping assays described in this study.

Figure 14B:
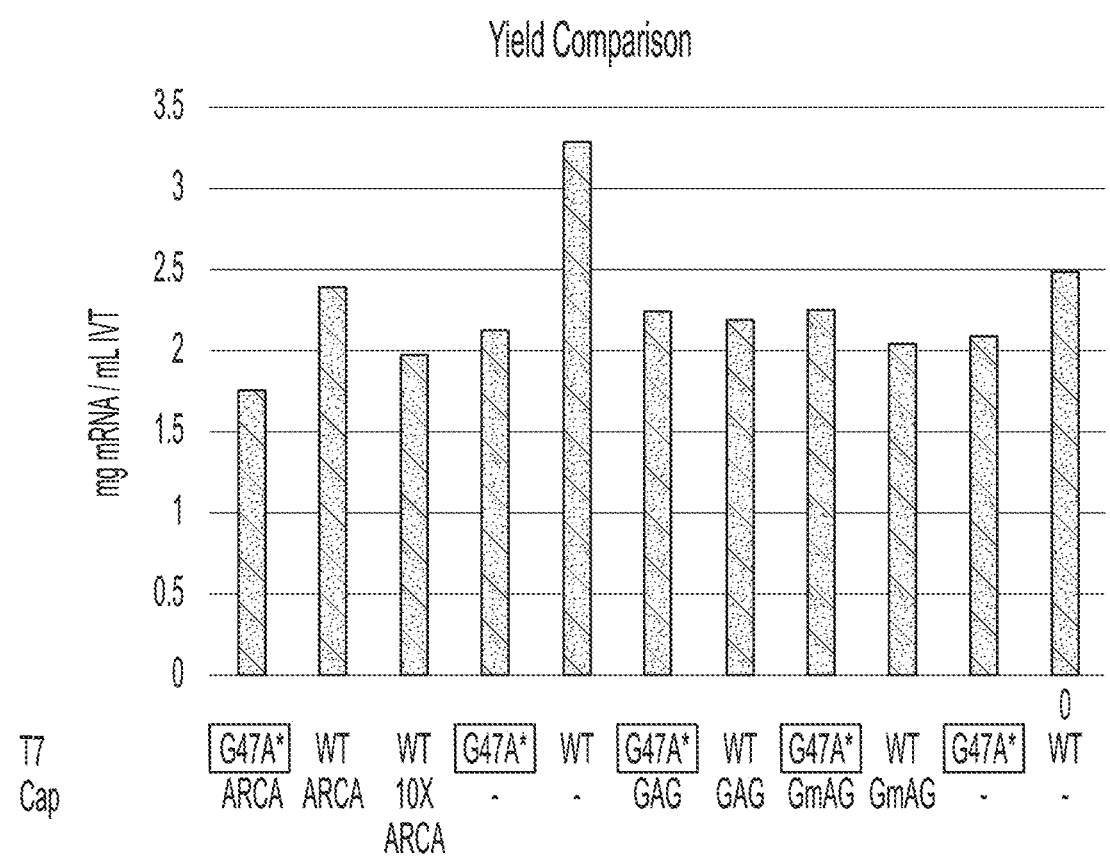
Figure 14C:
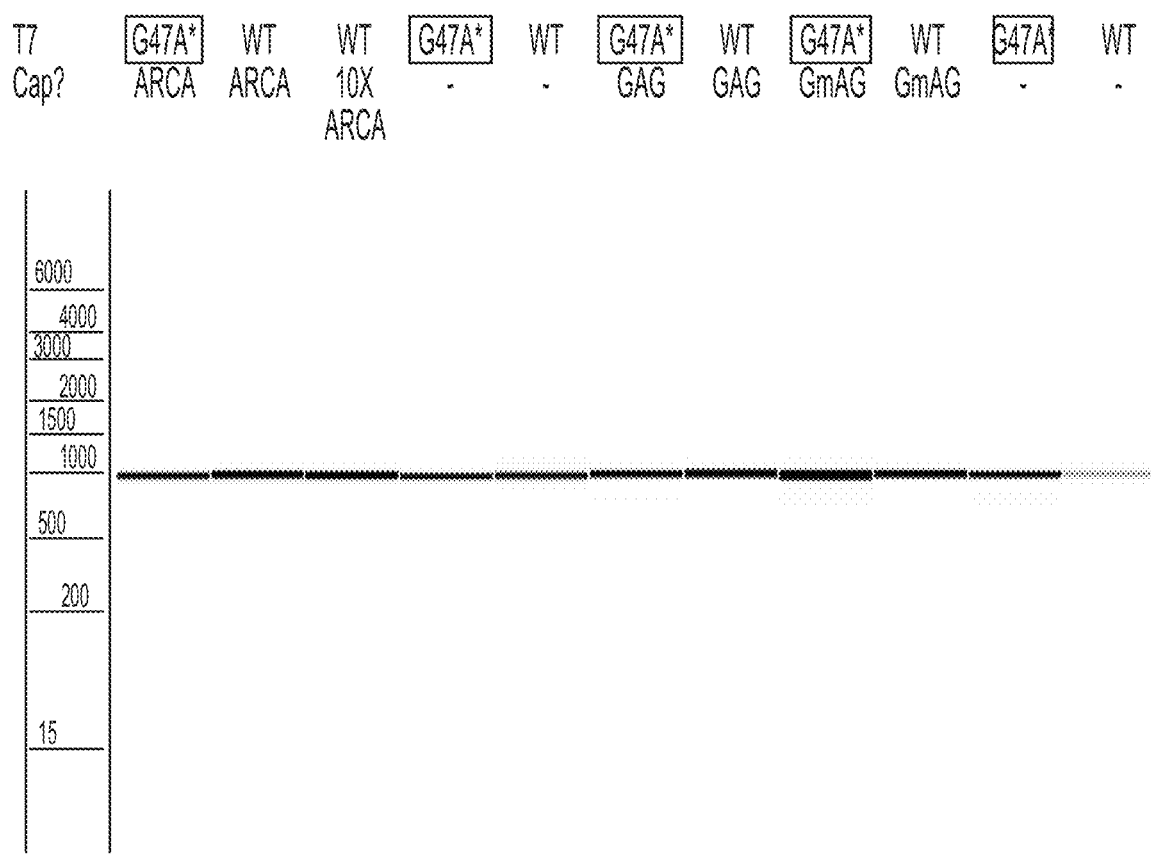

In a co-transcriptional capping assay, human EPO (hEPO) DNA template was used. Also present in the assay mixture were 5 mM NTP with or without 5 mM trinucleotides (″′GpppAG, ″′GmpppAG, and ARCA). The unmodified mRNA products were analyzed by RNase H cap assay or LCMS. As shown in Table 5, both wild type (WT) T7 RNA polymerase and the T7 RNA polymerase variant G47A* were able to produce fully capped mRNA with equally high efficiency. RNA yield was comparable among different IVT reactions (FIG. 14B) and mRNA products with high degree of integrity were produced (FIG. 14C).

TABLE 5

Capping Efficiency of WT T7 RNA polymerase or T7 RNA polymerase variant G47A*

| T7 RNA polymerase | Trinucleotide | Capping efficiency (%) |
|---|---|---|
| WT | — | 0.0 |
| T7 RNA polymerase variant G47A* | — | 0.0 |
| WT | m$^7$GpppAG | 93.9 |
| T7 RNA polymerase variant G47A* | m$^7$GpppAG | 100.0 |
| WT | m$^7$GpppAG | 100.0 |
| T7 RNA polymerase variant G47A* | m$^7$GpppAG | 100.0 |

Figure 14D:
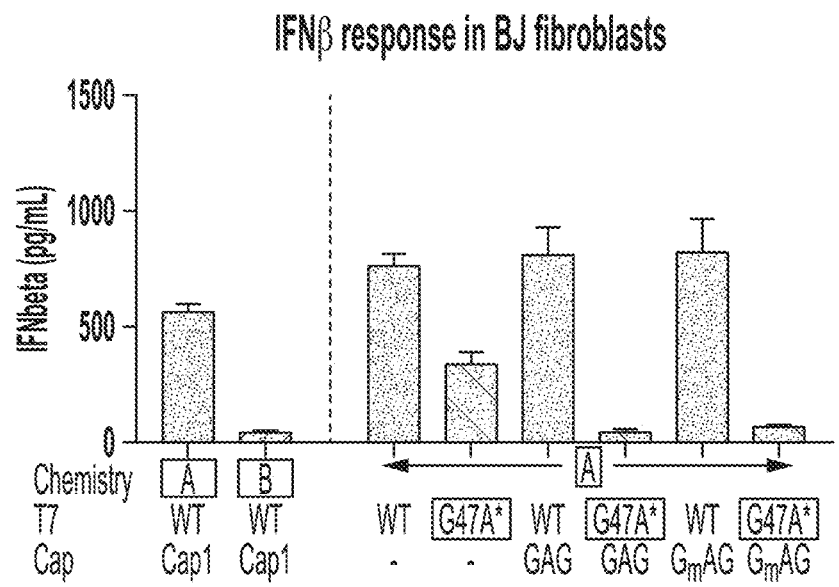
Figure 14E:
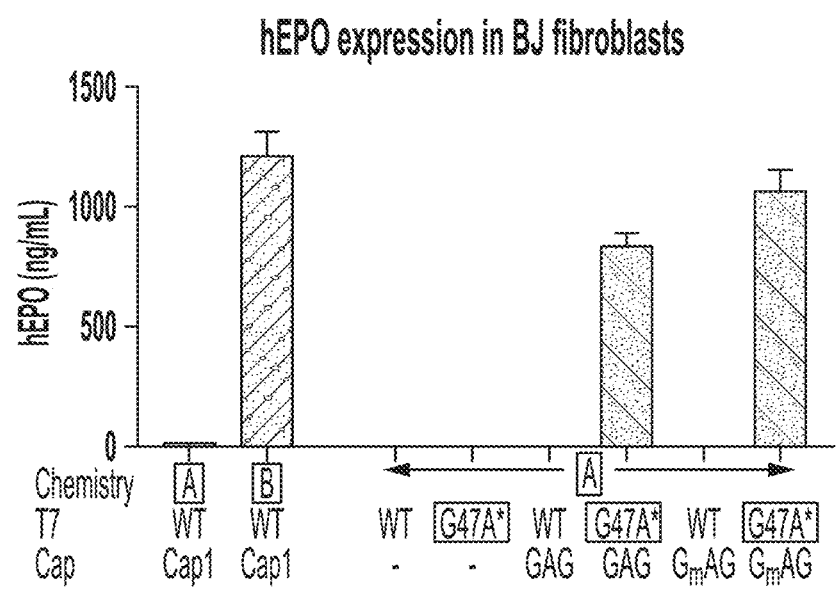
Figure 15:
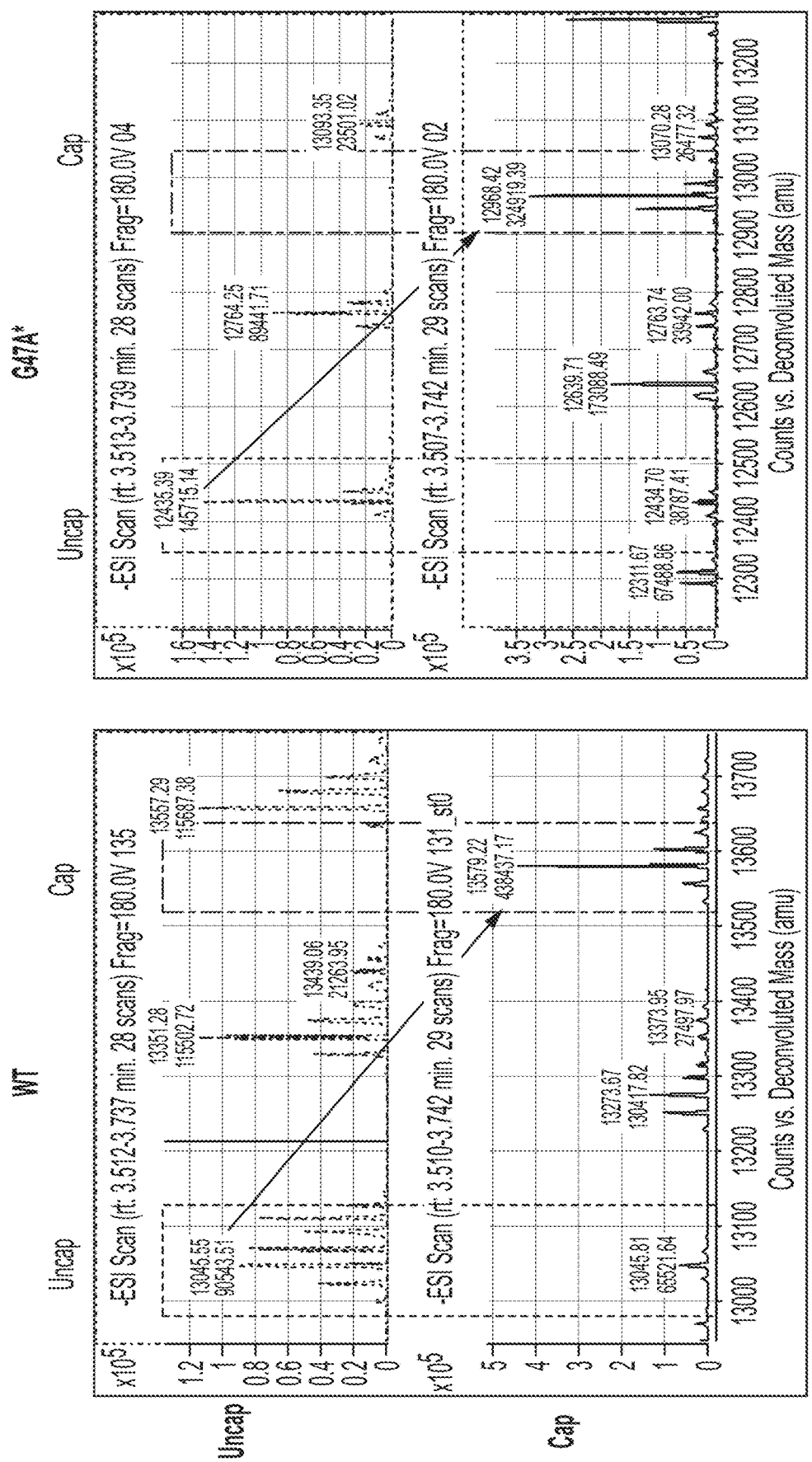
FIG. 15 shows the results of LC-mass spectrometry analysis of the mRNA produced in the co-transcriptional capping assay. The result shows unexpectedly that T7 RNA polymerase variant G47A* (with C-terminal G) produced cleaner mRNA than WT T7 RNA polymerase. The trinucleotide incorporation rates appeared equivalent for both enzymes.

The immune-stimulatory activity of the mRNA products was assessed by evaluating their ability to induce cytokine (IFNβ) production in BJ fibroblasts. Interestingly, WT T7 RNA polymerase produced unmodified mRNA that induced a high cytokine response, while T7 RNA polymerase variant G47A* produced unmodified mRNA that did not stimulate cytokine production in BJ fibroblasts (FIG. 14D), minimizing the need to further purify the RNA after the IVT/capping assay. hEPO expression from the mRNA products were also evaluated. No hEPO expression was observed from mRNA produced by WT T7 RNA polymerase, while mRNA produced by T7 RNA polymerase variant G47A* led to comparable hEPO expression as mRNA modified with 1-methyl-pseudourine capped with Vaccinia cap1 (FIG. 14E). LCMS experiments also shows that T7 RNA polymerase variant G47A* produced cleaner RNA than WT T7 RNA polymerase, though the trinucleotide incorporation efficiency appeared to be equivalent for the two enzymes (FIG. 15).

Figure 16B:
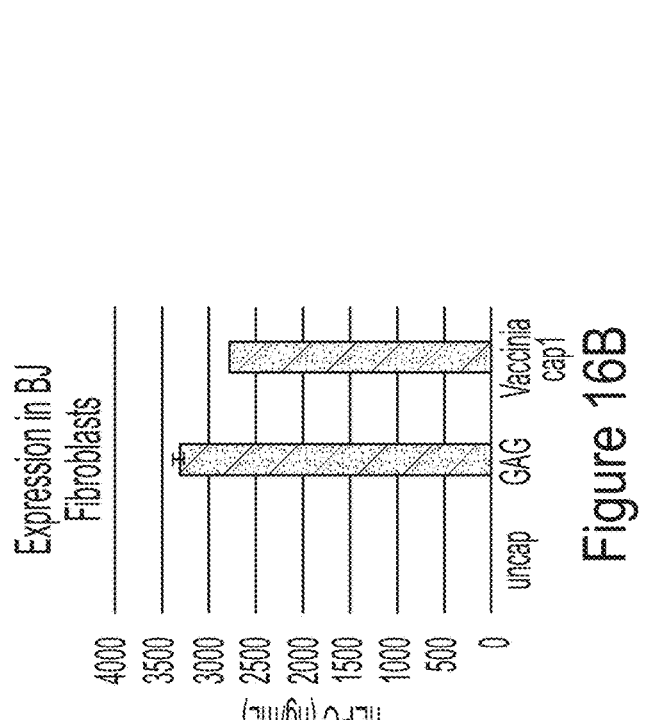
FIGS. 16A and 16B are graphs comparing the cytokine response (FIG. 16A) or expression (FIG. 16B) of mRNAs produced and capped with GAG trinucleotide in the co-transcriptional capping assay or capped in a standard capping assay with Vaccinia cap1.
Figure 16A:
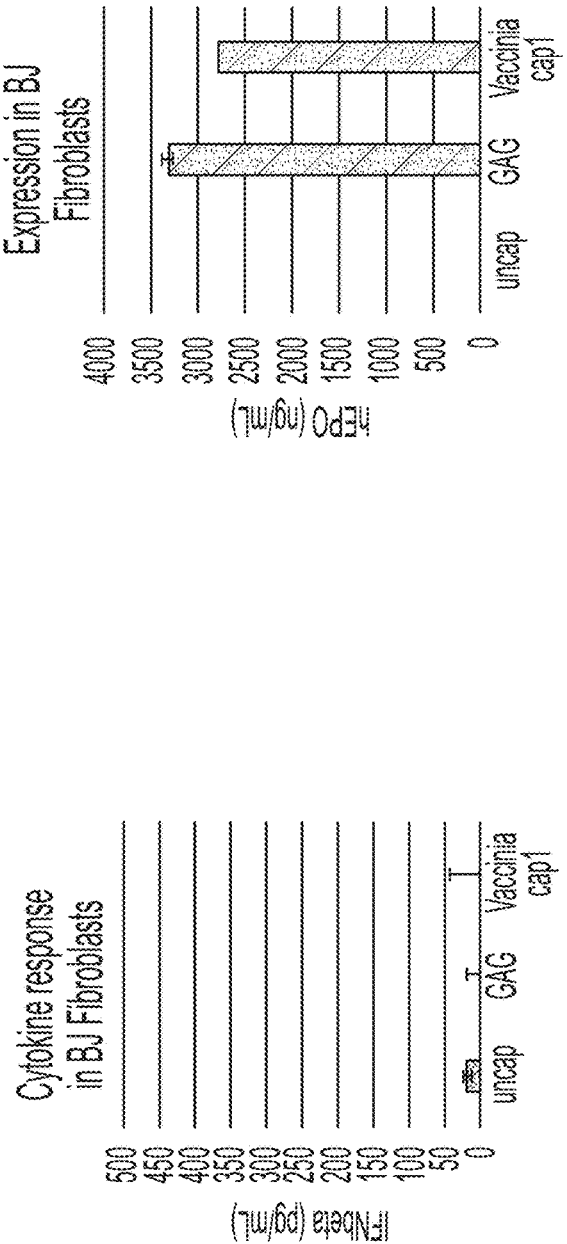

In a different experiment, the capping efficiency of T7 RNA polymerase variant G47A* was compared with the efficiency achieved in a standard capping assay using the Vaccinia cap1. In this experiment, the reaction mixture contained a hEPO dsDNA template with a deoxythymidine at position +1 on the template strand (also termed "Astart" for the first templated nucleotide), the T7 RNA polymerase variant G47A*, and equimolar (7.5 mM) NTPs and GAG trinucleotides. The resulting mRNA products were purified using oligo dT and analyzed for capping efficiency, in vitro cytokine response, and in vitro expression. The results show that T7 RNA polymerase variant G47A* produced capped mRNA with comparably high efficiency as the standard capping process (Table 6), that the mRNA did not induce cytokine response in BJ fibroblasts (FIG. 16A), and that the mRNA lead to high hEPO expression in BJ fibroblasts (FIG. 16B).

TABLE 6

Capping Efficiency of Co-transcriptional Capping and Standard Process

| Cap identity | % functional cap |
|---|---|
| Uncap | 0 |
| GAG (one-pot) | 96.0 |
| Vaccinia cap1 (+RP) | 99.8 |

Figure 17:
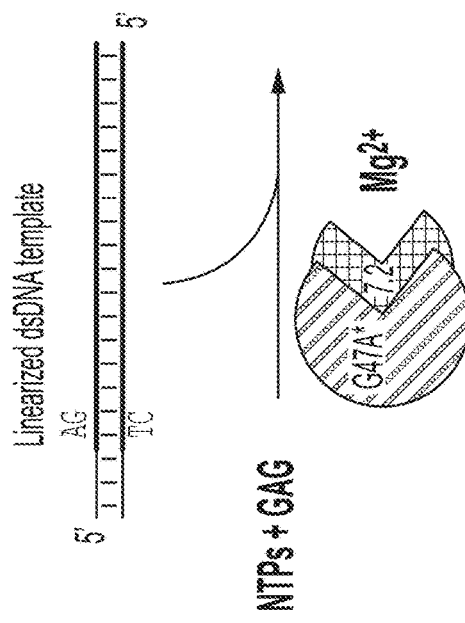
FIG. 17 is a schematic showing the co-transcriptionally capping assay described herein using T7 RNA polymerase variant G47A* and a trinucleotide cap $m^7GpppA_{2'Ome}pG$.

In summary, it was demonstrated herein that the T7 RNA polymerase variant G47A* can efficiently initiate transcription at the 3'dTTP of the template strand in the presence of XAG trinucleotides (e.g., GAG or GmAG). Provided at equimolar concentrations as the NTPs in the assays, the trinucleotides can be added co-transcriptionally to produce fully capped mRNAs that does not stimulate an immune response and results in high protein expression (FIG. 17).

Example 8. Comparison of Transcription Initiation with 5'GTP (Gstart) or 5'ATP (Astart)

Figure 18A:
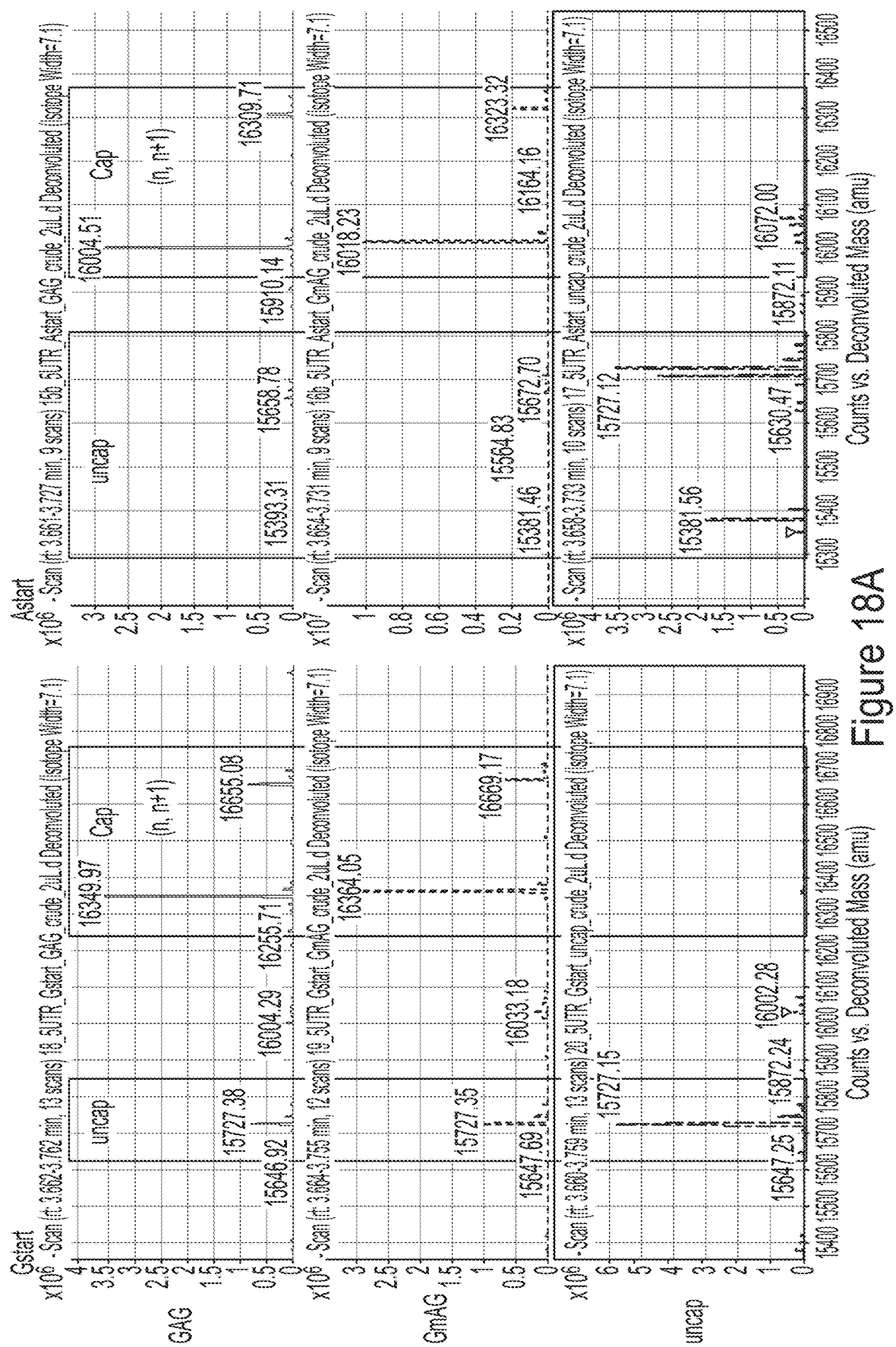
FIGS. 18A and 18B are liquid chromatography-mass spectrometry (LCMS) results showing the comparison of capping efficiency for mRNAs that start with 5'ATP or 5'GTP.

Using the co-transcriptional capping assays described in Example 7, the capping efficiency on model constructs where transcription initiation requires 5'-GTP (Gstart) or a 5'-ATP (Astart) were compared. A model construct encoding a 5'UTR and a 47-mer RNA oligonucleotide was used as template for IVT. The total RNA products were assessed by mass spectrometry and the results show that Astart constructs more efficiently incorporate the GAG or GmAG trinucleotides, compared to Gstart constructs (FIG. 18A). Though the data is not shown here, it was also observed that Cstart and Ustart constructs produced low amounts of capped products.

Further, the RNA products were subject to RNase H cleavage and the cleaved 5' ends of the RNA products were analyzed using mass spectrometry to determine the presence of the cap. Similar results were obtained as that of the total RNA products (FIG. 18B).

Figure 18B:
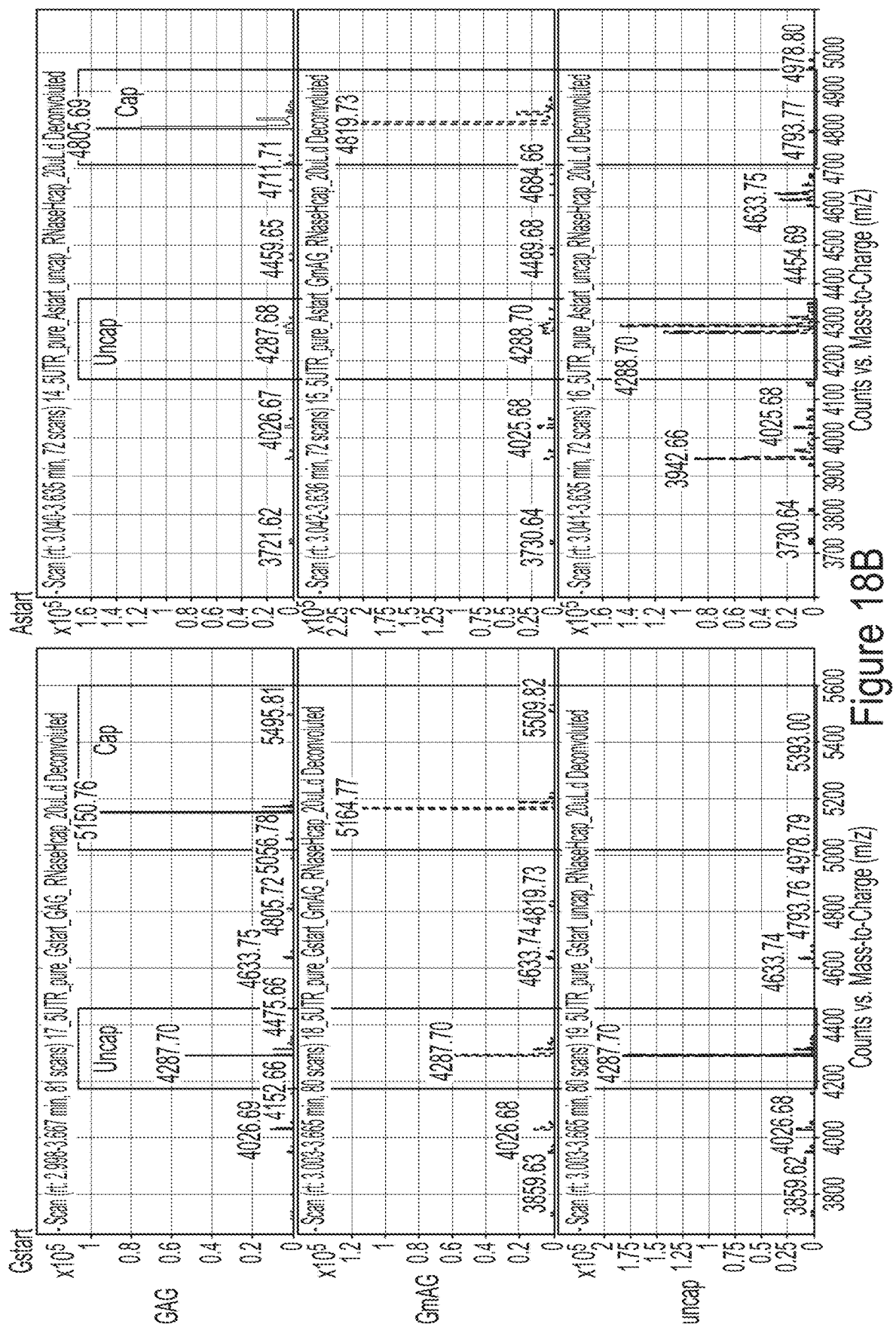

A trinucleotide titration experiment was also performed using the model construct used in FIGS. 18A and 18B. In the co-transcriptional capping assay, 5 mM of NTPs (A, modified U, G, C at equimolar ratio) were used while the concentration of the trinucleotide (GAG or GmAG) varied to evaluate capping efficiency at different molar ratios of the NTP and the trinucleotide. The crude RNA products were then analyzed by LC-MS. The result shows that capping efficiency is the highest when the NTP and the trinucleotide are at equimolar ratio for both GAG and GmAG (Table 7).

TABLE 7

Trinucleotide Titration

| Trinucleotide concentration (mM) | % Cap (GAG) | % Cap (GmAG) |
|---|---|---|
| 5 (EQ) | 96.0 | 88.3 |
| 4 | 92.8 | 85.6 |

TABLE 7-continued

Trinucleotide Titration

| Trinucleotide concentration (mM) | % Cap (GAG) | % Cap (GmAG) |
|---|---|---|
| 3 | 90.3 | 82.8 |
| 2 | 81.7 | 74.5 |
| 1 | 66.1 | 57.0 |
| 0.5 | 42.5 | 48.6 |
| 0 | 0 | 0 |

Example 9. Capping of mRNAs Chemically Modified with 1-Methyl-Pseudouridine

Co-transcriptional capping of mRNAs chemically modified with 1-methyl-pseudouridine were also assessed. Three model constructs were used: hEPO, Luc (encoding luciferase), and eGFP. All IVT templates were Astart templates. The templates may be PCR fragments or plasmids. The capping assay reaction mixture contained the template, T7 RNA polymerase variant G47A*, 7.5 mM of NTPs, and 7.5 mM of trinucleotides (GAG or GmAG). The UTPs in the NTPs were replaced by 1-methylpseudouridine to produce chemically-modified mRNA. Vaccinia cap1 was used as a production control in a standard capping assay. The mRNA products were analyzed using RNase H cap assay, T1 fingerprinting, and a fragment analyzer to determine their integrity. The abilities of the mRNA products in inducing cytokine response and expressing the encoded protein in BJ fibroblasts were also tested.

Figure 19A:
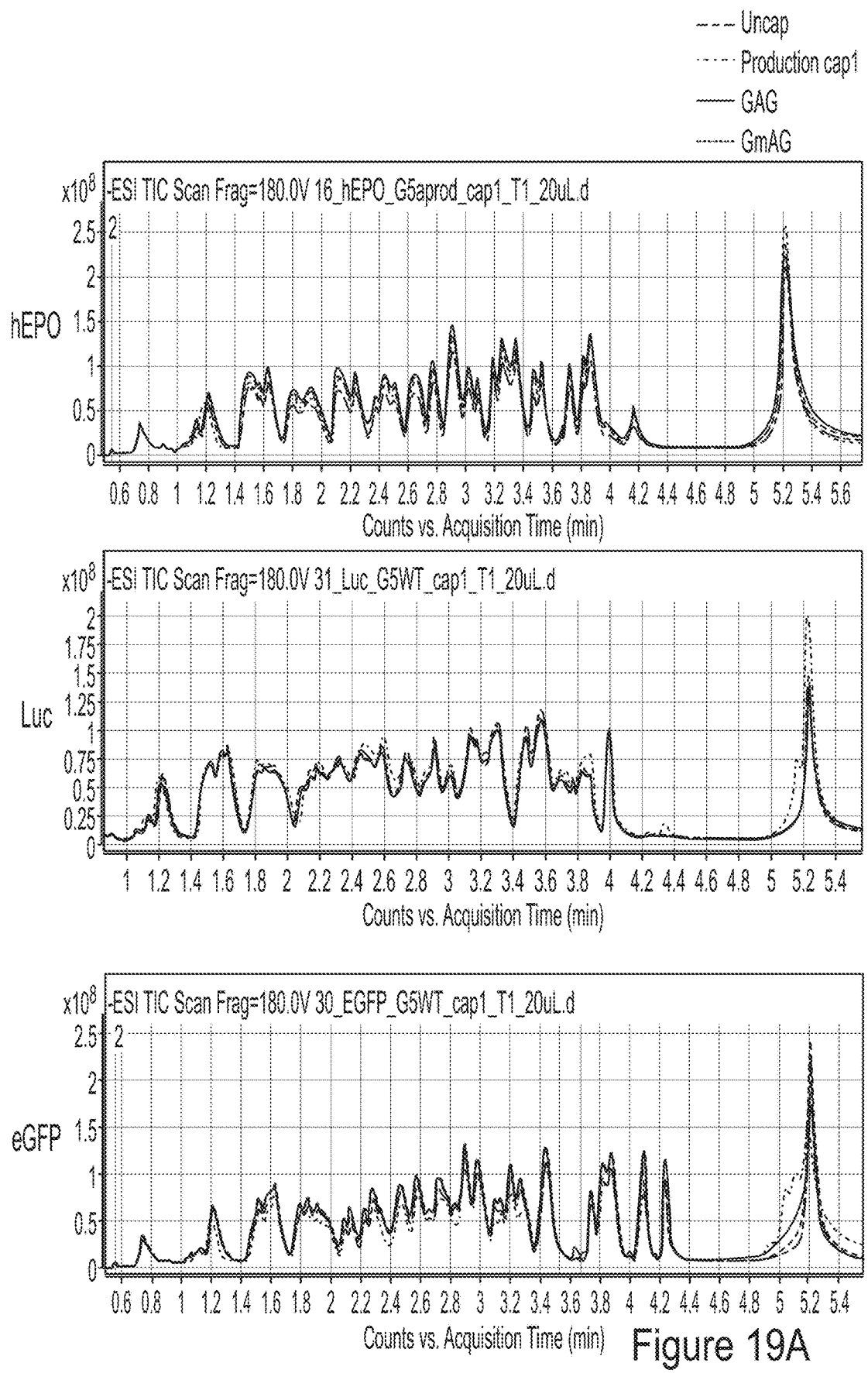
FIGS. 19A-19C are graphs showing the analysis of mRNA chemically modified with 1-methyl-pseudouridine produced from PCR fragment templates for three model constructs (hEPO, luciferase, and eGFP).
Figure 19B:
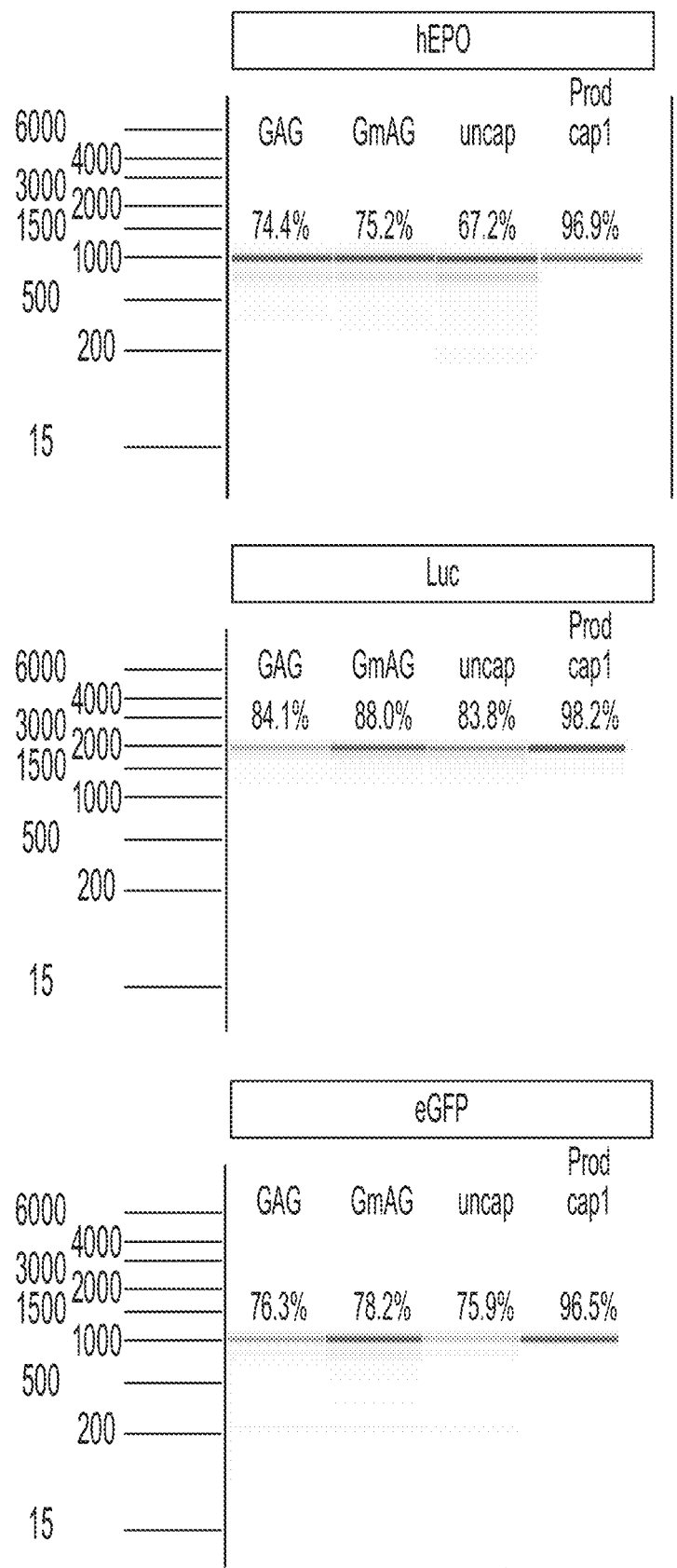
Figure 19C:
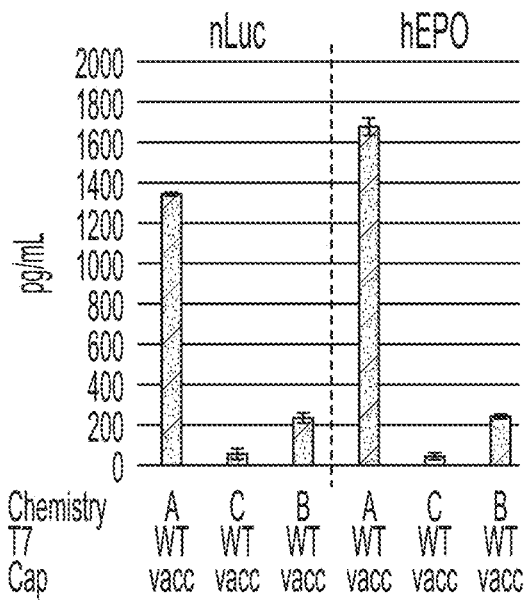
Figure 19C:
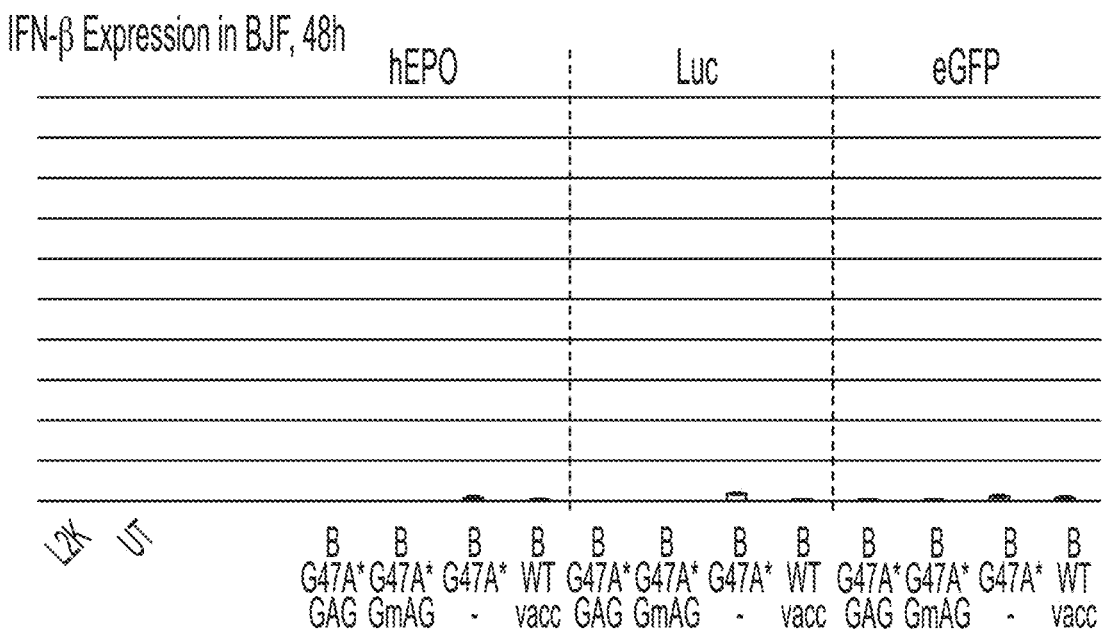
Figure 20A:
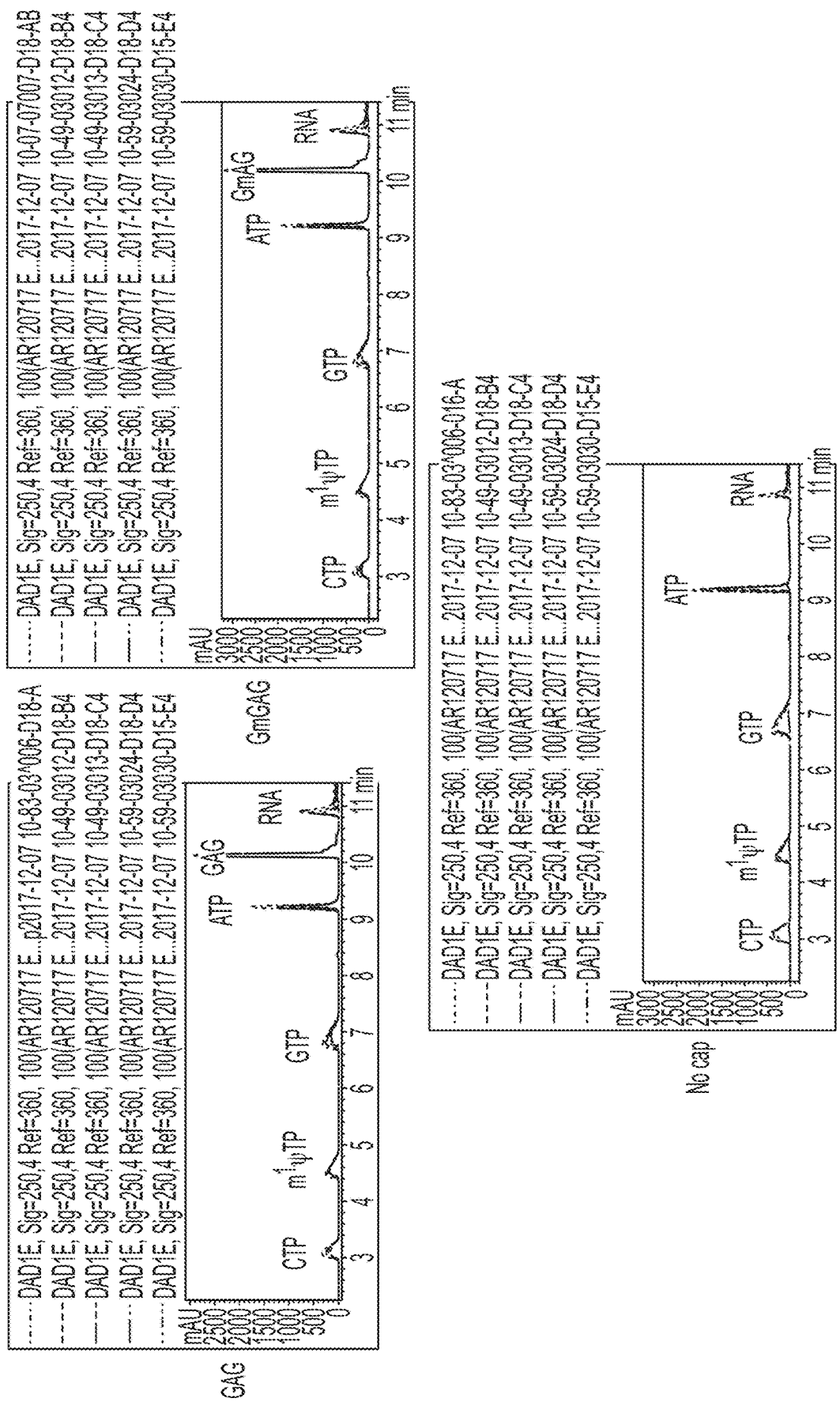
FIGS. 20A-20G are graphs showing the analysis of mRNAs chemically modified with 1-methyl-pseudouridine produced from plasmid templates for three model constructs (hEPO, Luc, and eGFP). The NTP consumption in the co-transcriptional capping assays using hEPO plasmids (FIG. 20A) or eGFP plasmids (FIG. 20B) as templates are shown.

As shown in Table 8, the mRNA chemically modified with 1-methyl-pseudouridine for all three model constructs produced from PCR fragment templates were efficiently capped, the capping efficiency was comparable to the vaccinia cap1 control. Chemistry A denotes use of unmodified uridine triphosphate nucleotide and Chemistry B denotes use of 1-methyl-pseudouridine triphosphate nucleotide. Chemistry C denotes 5-methyl-cytidine triphosphate and 1-methyl-pseudouridine triphosphate nucleotides. Similar results were obtained for mRNA chemically modified with 1-methyl-pseudouridine produced from plasmid templates (Table 9). Further, RNase T1 fingerprinting analysis showed that the mRNAs produced from the model constructs using PCR fragment templates were of correct sequence (FIG. 19A). The mRNA produced from either PCR fragment templates (FIG. 19B) or plasmid templates (FIG. 20C) were also shown to have high degree of integrity. The capped mRNAs produced from PCR fragment templates as well as plasmid templates did not induce any cytokine expression in BJ fibroblasts (FIG. 19C, FIG. 20D). Further, mRNAs produced from plasmid templates resulted in expression of the encoded proteins in BJ fibroblasts (FIGS. 20E-20G). The expression levels for GAG-capped mRNAs were slightly higher, comparable or slightly lower than the expression levels from the Vaccinia cap1 control mRNAs.

TABLE 8

Capping Efficiency of mRNA chemically modified with 1-methyl-pseudouridine - PCR Fragment Templates

| Construct | Cap | % Cap (% reported) |
|---|---|---|
| hEPO | Uncap | 0 |
| hEPO | Cap1 (vaccinia) | 99.8 (n/a) |
| hEPO | GAG (trinucleotide) | 96.1 |
| hEPO | GmAG (trinucleotide) | 94.9 |
| Luc | Uncap | 0 |
| Luc | Cap1 (vaccinia) | 85.7 (100%) |
| Luc | GAG (trinucleotide) | 94.4 |
| Luc | GmAG (trinucleotide) | 93.3 |
| eGFP | Uncap | 0 |
| eGFP | Cap1 (vaccinia) | 99.4 (88%) |
| eGFP | GAG (trinucleotide) | 93.8 |
| eGFP | GmAG (trinucleotide) | 94.9 |

TABLE 9

Capping Efficiency of mRNA chemically modified with 1-methyl-pseudouridine - Plasmid Templates

| Construct | Cap | % Cap (% reported) |
|---|---|---|
| hEPO | Uncap | 0 |
| hEPO | Cap1 (vaccinia) | 99.8 (n/a) |
| hEPO | GAG (trinucleotide) | 96.4 |
| hEPO | GmAG (trinucleotide) | 96.3 |
| Luc | Uncap | 0 |
| Luc | Cap1 (vaccinia) | 85.7 (100%) |
| Luc | GAG (trinucleotide) | 95.7 |
| Luc | GmAG (trinucleotide) | 99.6 |
| eGFPegd | Uncap | 0 |
| eGFPdeg | Cap1 (vaccinia) | 92.1 (n/a) |
| eGFPdeg | GAG (trinucleotide) | 94.3 |
| eGFPdeg | GmAG (trinucleotide) | 92.1 |

Figure 20B:
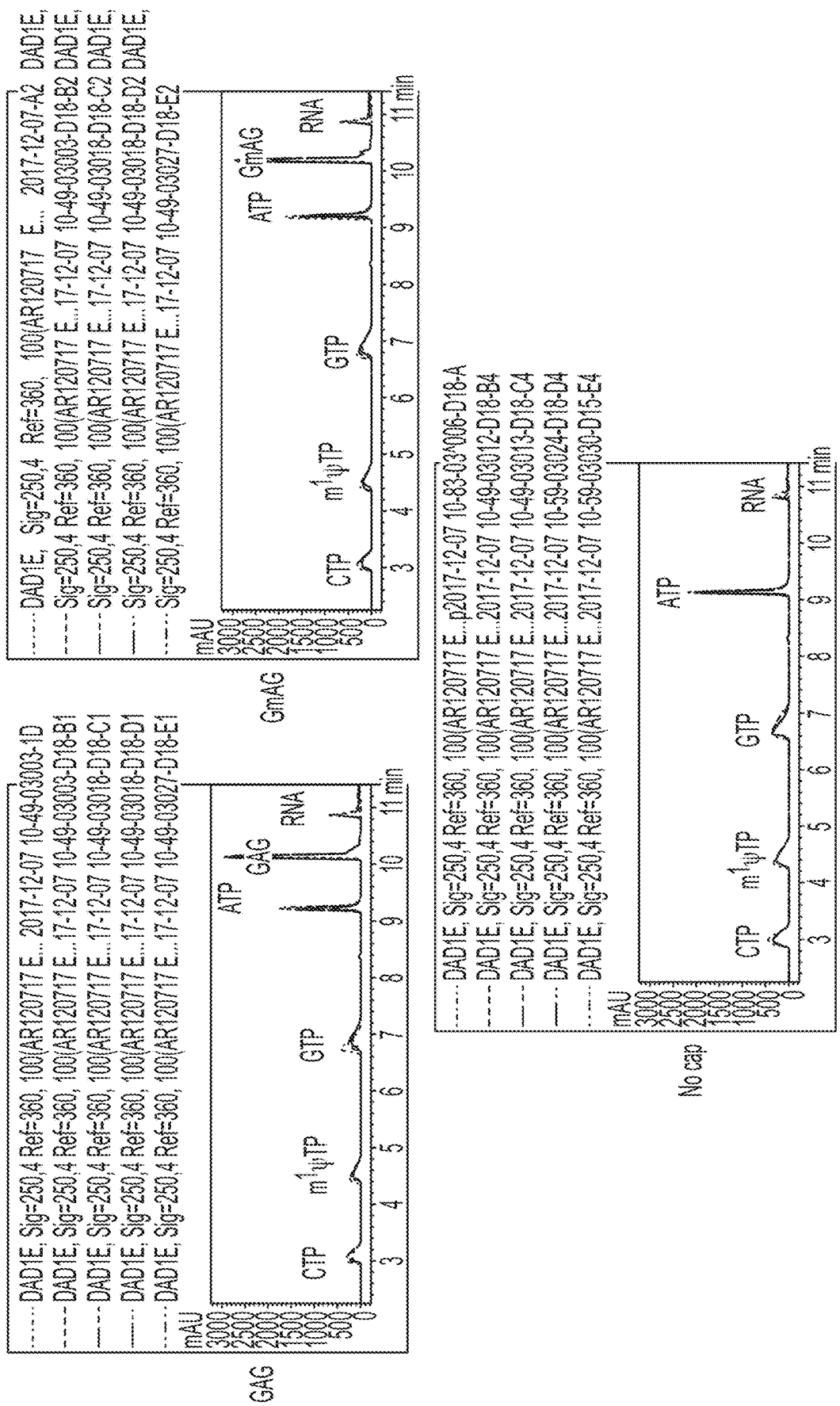
Figure 20C:
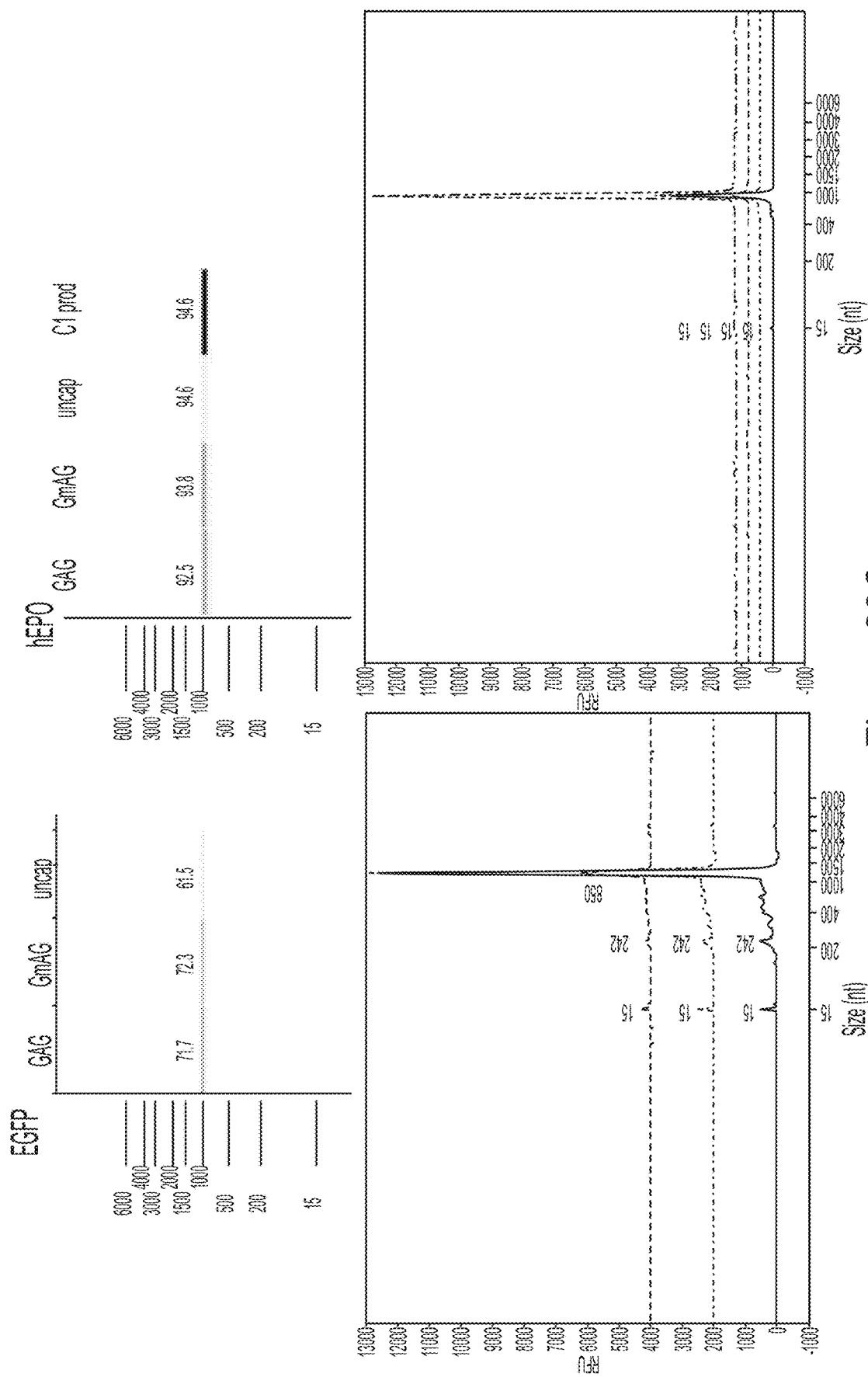
Figure 20D:
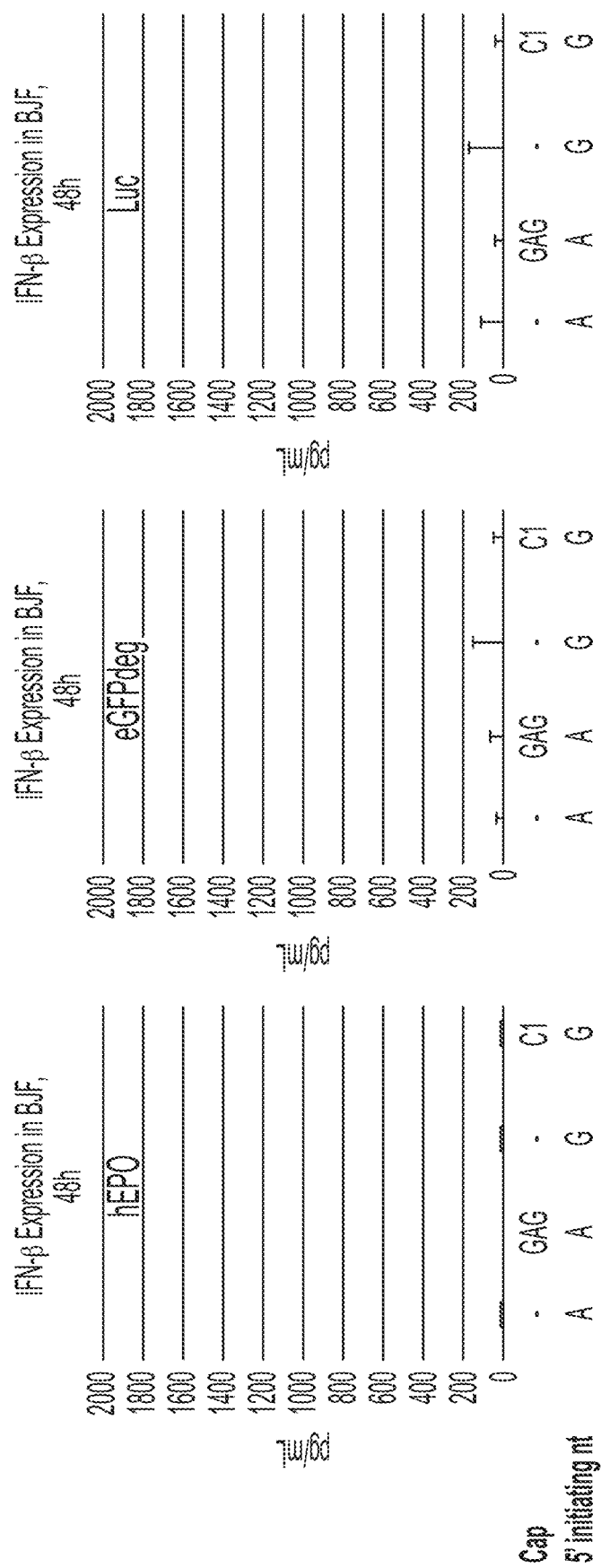
Figures 20E, 20F, 20G:
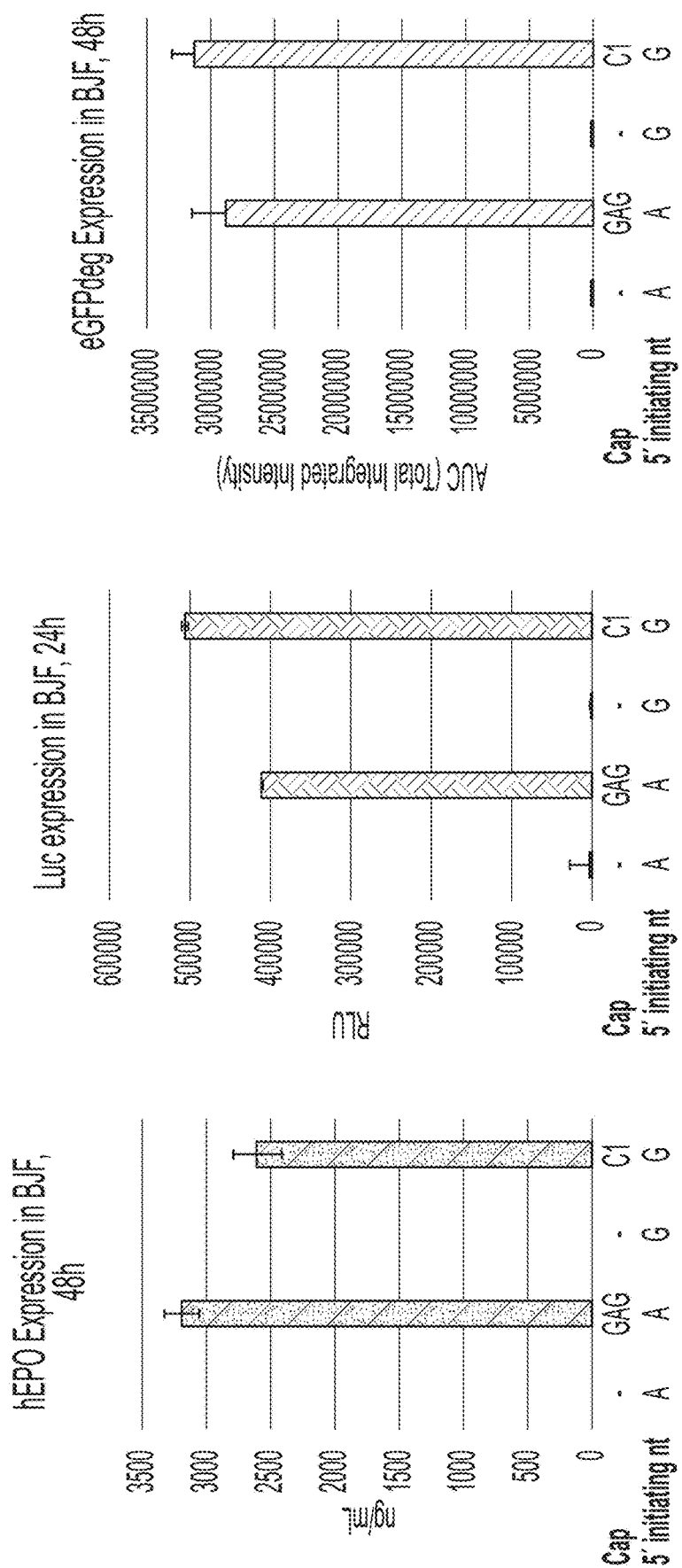

The NTP consumption in the co-transcriptional capping assay were also assessed for reactions using plasmid templates for model constructs hEPO (FIG. 20A) and eGFP (FIG. 20B). The results show that the trinucleotides GAG and GmAG were hardly consumed throughout the duration of the assay (2 hours). This is consistent with the fact that the concentration of the trinucleotides in the assay was in extreme excess. It may be possible to recover trinucleotides after the assay is completed.

Example 10. Substitutions at the T7 RNA Polymerase C-Terminus Impact RNA Yields G47A* polymerase contains an extra glycine at the C-terminus ("foot glycine") of the translated protein. The presence of this foot glycine was confirmed by trypsin digest and mass spectrometry analysis of purified G47A* protein (data not shown). The role of the C-terminal foot region of G47A* was examined in greater detail because of its proximity to the active site of G47A*.

In vitro transcription (IVT) reactions were performed using hEPO DNA template and (1) a wild-type (WT) T7 RNA polymerase (WT), (2) a WT T7 RNA polymerase with a foot glycine (WT+G), (3) a WT T7 RNA polymerase with two foot glycines (WT+GG), (4) a wild-type RNA polymerase with two foot alanines (WT+AA), (5) a G47A T7 RNA polymerase variant, (6) a G47A* T7 RNA polymerase variant with a foot glycine (G47A+G), (7) a G47A T7 RNA polymerase variant with two foot glycines (G47A+GG), (7) a G47A T7 RNA polymerase variant with two foot alanines (G47A+AA), (9) a S43A/G47A T7 RNA polymerase variant (S43A/G47A), and (10) a S43A/G47A T7 RNA polymerase variant with a foot glycine (S43A/G47A+G). IVT reaction mixtures contained hEPO DNA template, one of the T7

Figure 22:
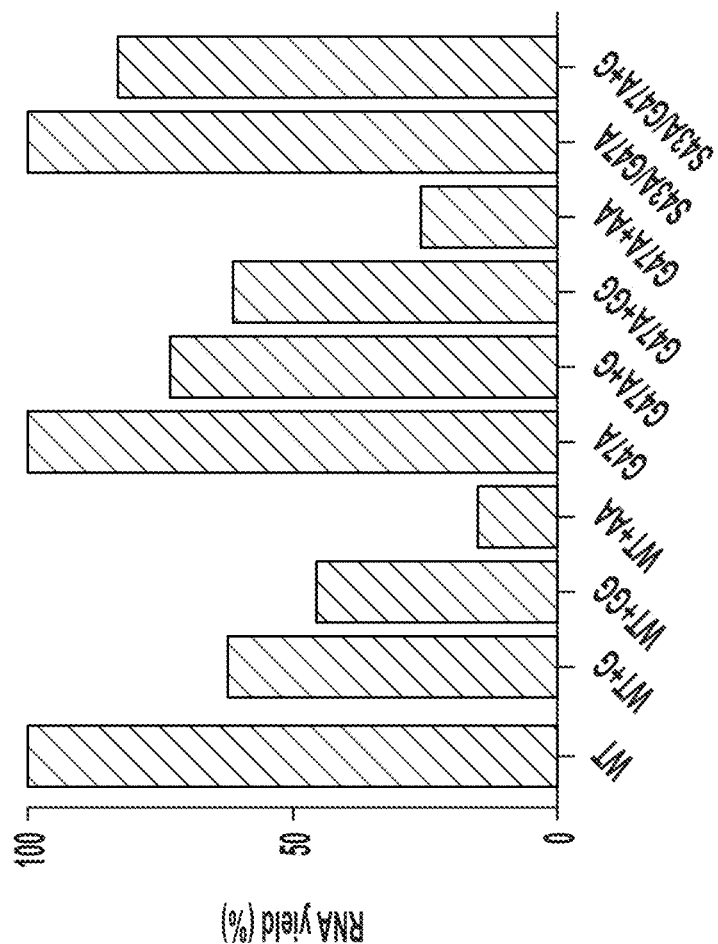
FIG. 22 shows unmodified hEPO mRNA production from IVT reactions containing WT or G47A T7 RNAP variants, some of which have additional amino acids at the C-terminus (e.g., one or two glycines, or two alanines).
Figure 21:
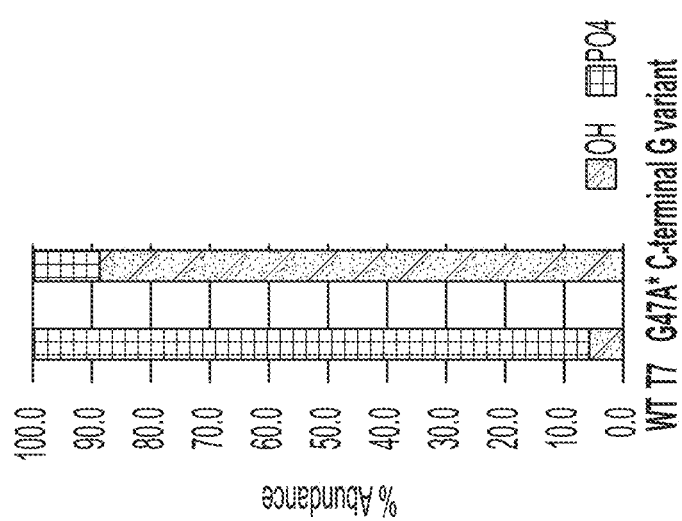
FIG. 21 is a graph showing that greater than 85% (e.g., ~90%) of the mRNA transcripts produced using T7 RNAP variant G47A* comprising a C-terminal glycine (G) have a hydroxyl group at the 3' end.
Figure 23:
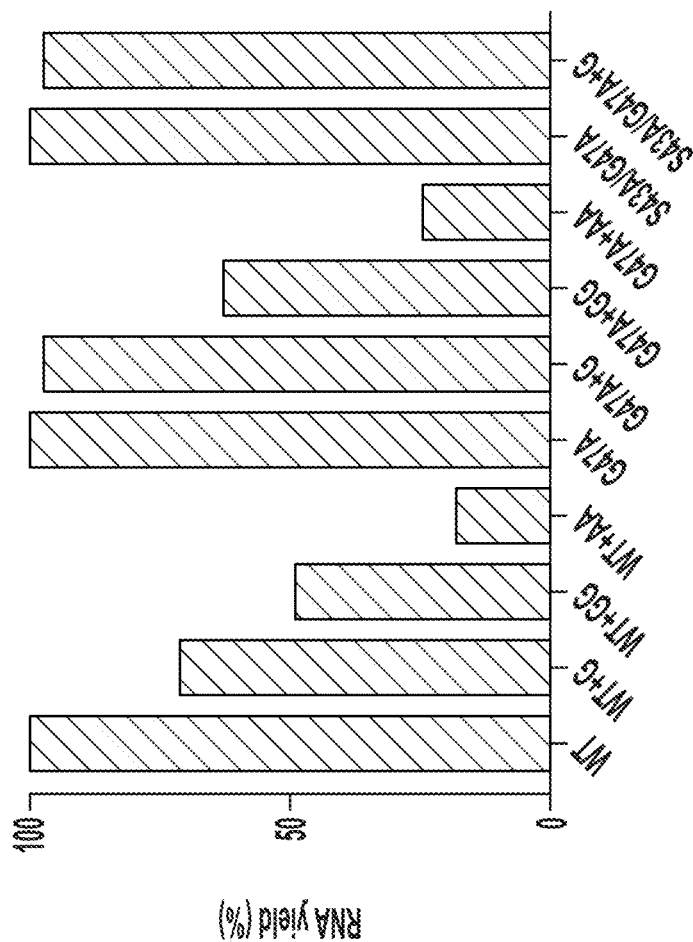
FIG. 23 shows 1-methyl-pseudouridine-modified hEPO mRNA production from IVT reactions containing WT, G47A, or S43A/G47A T7 RNAP variants as indicated, some of which have additional amino acids at the C-terminus (e.g., one or two glycines or two alanines).

RNA polymerase variants listed above, and NTPs. IVT reactions with unmodified chemistry (FIG. 22) were performed with standard NTPs (ATP, CTP, GTP, UTP), while IVT reactions with pseudouridine-modified (m1ψ) chemistry (FIG. 23) contained 1-methylpseudouridine instead of UTP to produce chemically-modified mRNA. RNA yield was measured by UV absorption.

hEPO mRNA yield decreased with the presence of a foot glycine in either WT or G47A* variant T7 RNA polymerase (FIGS. 22-23). mRNA yield continued to decrease with either two foot glycines or two foot alanine residues, although there was less of a decrease with G47A* than with WT T7 RNA polymerase.

Figure 24A:
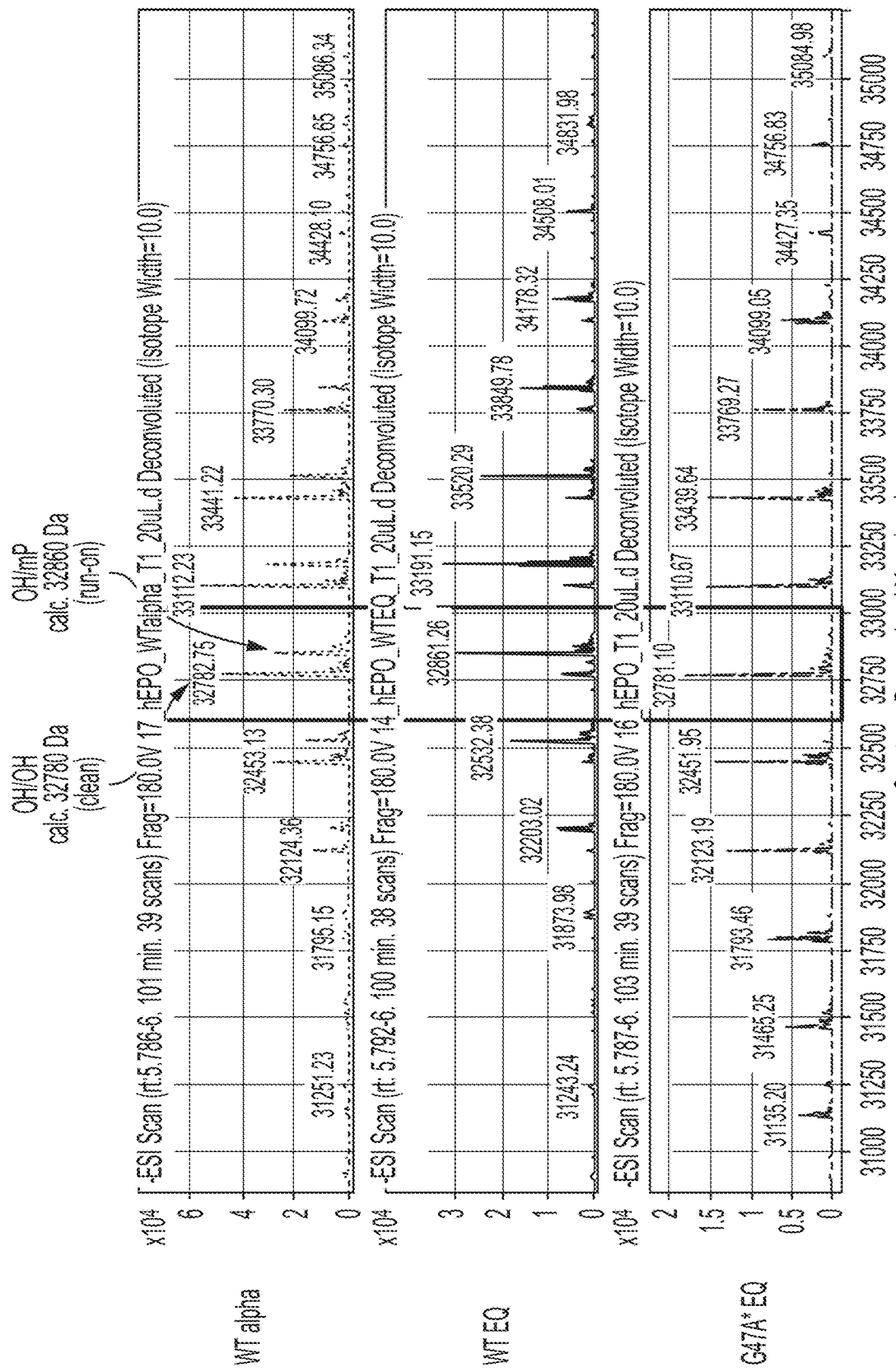
FIGS. 24A-24D show results from a RNase T1 tail digest of hEPO mRNA transcript produced using WT, G47A, or S43A/G47A T7 RNAP variants as indicated, some of which have additional amino acids at the C-terminus (e.g., one or two glycines or two alanines).
Figure 24C:
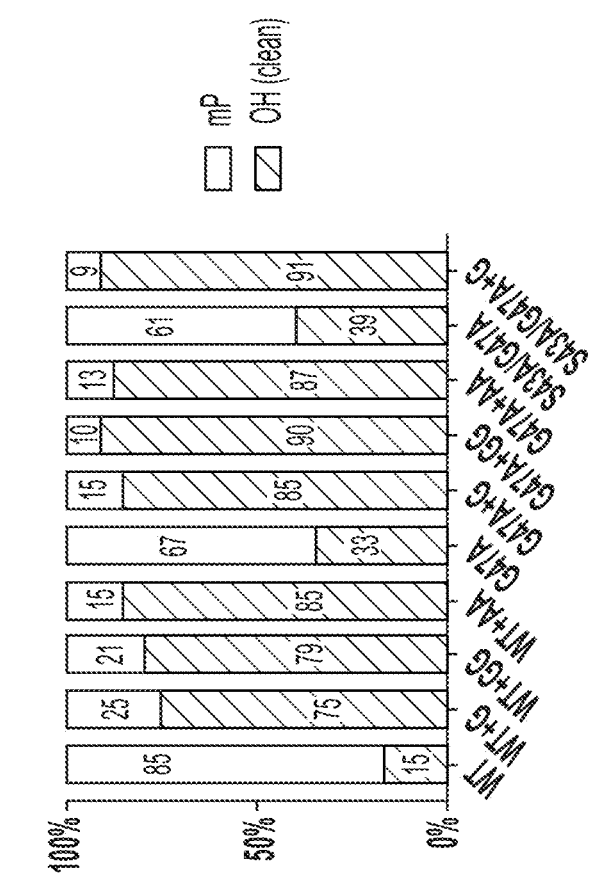
Figure 24B:
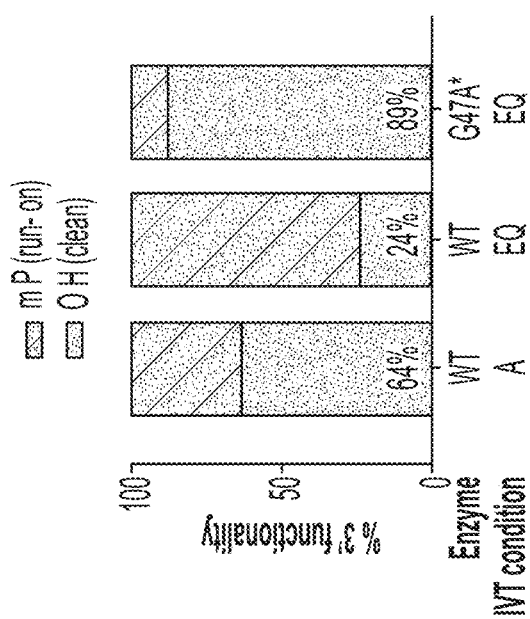

Example 11. Impact of T7 RNA Polymerase Foot Glycine on 3'-mRNA Heterogeneity hEPO mRNA produced using WT or G47A* T7 RNAP with a foot glycine was digested with RNAse T1 and analyzed by LCMS to generate oligo fingerprints as in Example 5. WT T7 RNAP IVT reactions were conducted with either equimolar concentrations of NTPs (WT EQ) or with molar excess of GTP and ATP (WT alpha (A)). LCMS analysis revealed a clean 3' end (5' OH/3' OH) peak at 32780 Da, and a 'scar' (5' OH/3' mP) peak at 32860 Da (FIG. 24A). A 'scar' indicates that the transcript had non-templated additions at the 3' end. hEPO mRNA produced using WT T7 RNAP and equimolar concentrations of NTPs (WT EQ) had decreased 3' end population distribution, indicating decreased 3' homogeneity and more run-on products with non-templated additions (FIG. 24B). However, hEPO mRNA produced using G47A* T7 RNAP with a foot glycine had a higher 3' end population distribution, indicating that they have cleaner 3' ends and improved 3' end heterogeneity (FIG. 24B).

Figure 24D:
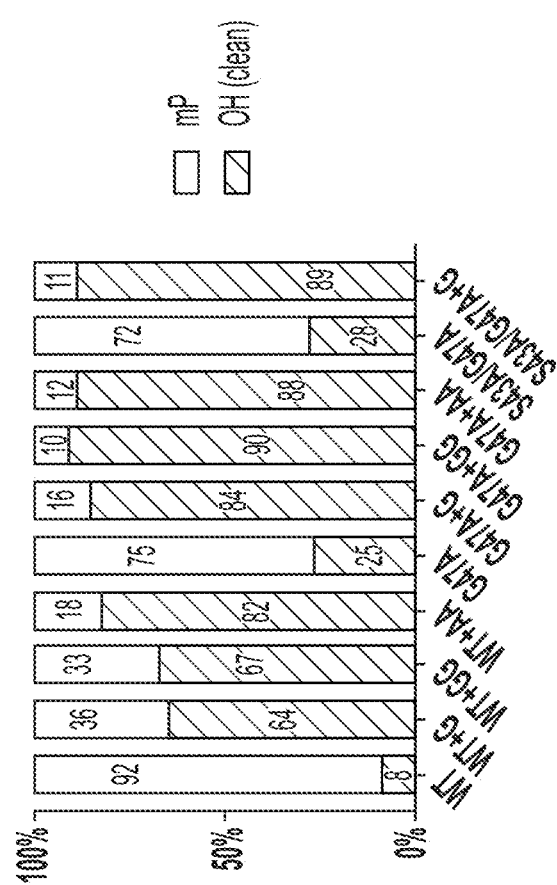

To directly examine the effect of the T7 RNAP foot region on hEPO 3' mRNA homogeneity, IVT reactions were performed using hEPO DNA template and (1) a wild-type T7 RNAP (WT), (2) a WT T7 RNAP with a foot glycine (WT+G), (3) a WT T7 RNAP with two foot glycines (WT+GG), (4) a wild-type T7 RNAP with two foot alanines (WT+AA), (5) a G47A T7 RNAP variant, (6) a G47A* T7 RNAP variant with a foot glycine (G47A+G), (7) a G47A T7 RNAP variant with two foot glycines (G47A+GG), (8) a G47A T7 RNAP variant with two foot alanines (G47A+AA), (9) a S43A/G47A T7 RNAP variant (S43A/G47A), and (10) a S43A/G47A T7 RNAP variant with a foot glycine (S43A/G47A+G). IVT reaction mixtures contained hEPO DNA template, one of the T7 RNAP variants listed above, and equimolar NTPs. IVT reactions were conducted which produced either unmodified mRNA (FIG. 24C) or pseudouridine modified mRNA (FIG. 24D). The hEPO mRNA was digested with RNase T1 as in Example 5 and above. The presence of a foot glycine increased hEPO mRNA 3' end homogeneity by 60% (FIGS. 24C-24D). Two foot glycines or two foot alanines in T7 RNAP also improved 3' end homogeneity by 60-70% over WT or G47A T7 RNAPs (FIGS. 24C-24D). These results indicate the presence of a single foot glycine in T7 RNAP can increase the 3' end homogeneity observed in FIG. 24B.

Example 12. Impact of T7 RNAP Foot Glycine on Immune Stimulation

Figures 25A, 25B:
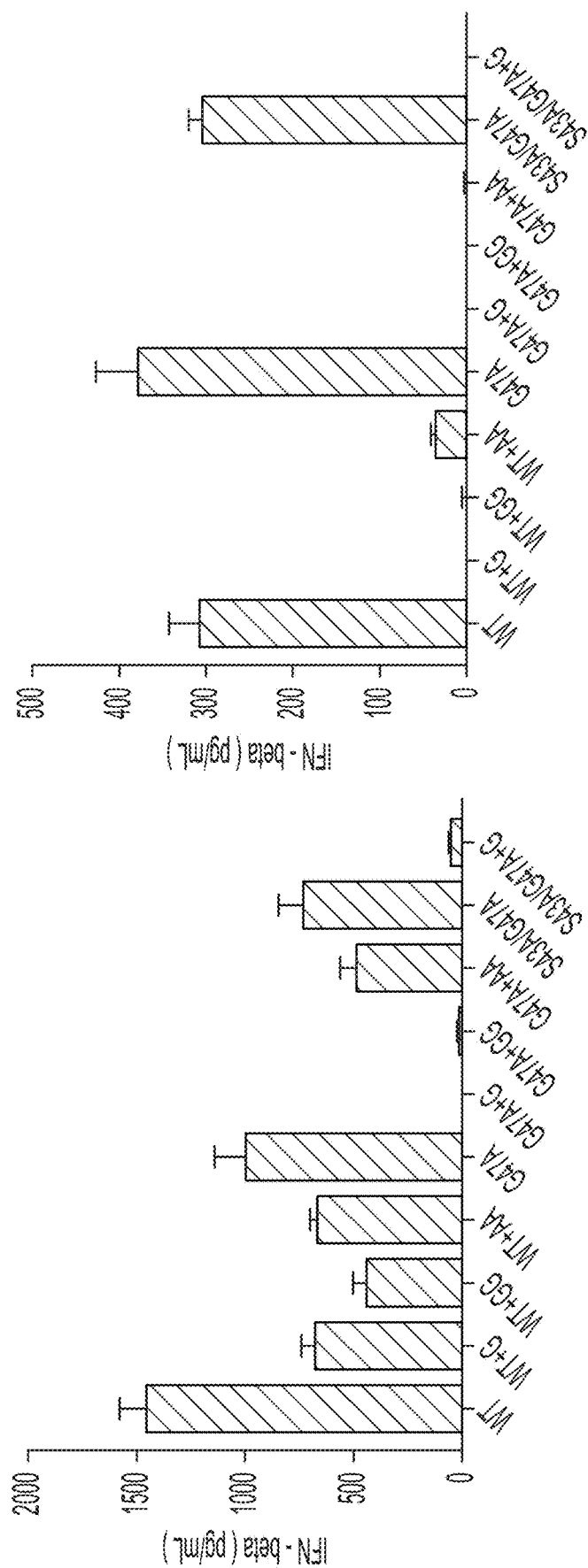
FIGS. 25A-25B are graphs comparing the cytokine response of BJ fibroblasts to unmodified (FIG. 25A) and 1-methyl-pseudouridine-modified (FIG. 25B) mRNAs produced from IVT reactions containing WT, G47A, or S43A/G47A T7 RNAP variants as indicated, some of which have substitutions at the C-terminus.

The role of T7 RNAP foot glycine in stimulating an immune response to hEPO mRNA products was assessed by evaluating their ability to induce cytokine (IFNβ) production in BJ fibroblasts as in Example 7. Interestingly, while WT T7 RNAP-produced unmodified and pseudouridine-modified hEPO mRNA induced a high cytokine response, WT T7 RNAP with a foot glycine-produced unmodified and pseudouridine-modified hEPO mRNA stimulated less cytokine production in BJ fibroblasts (FIG. 25). hEPO mRNA produced by G47A* variant T7 RNAP with a foot glycine failed to stimulate cytokine production in BJ fibroblasts, indicating an additive effect between the foot glycine and G47A T7 RNA polymerase variant in failing to induce an immune response (FIG. 25).

Example 13. Impact of T7 RNA Polymerase Foot Glycine on mRNA Production

Figure 26A:
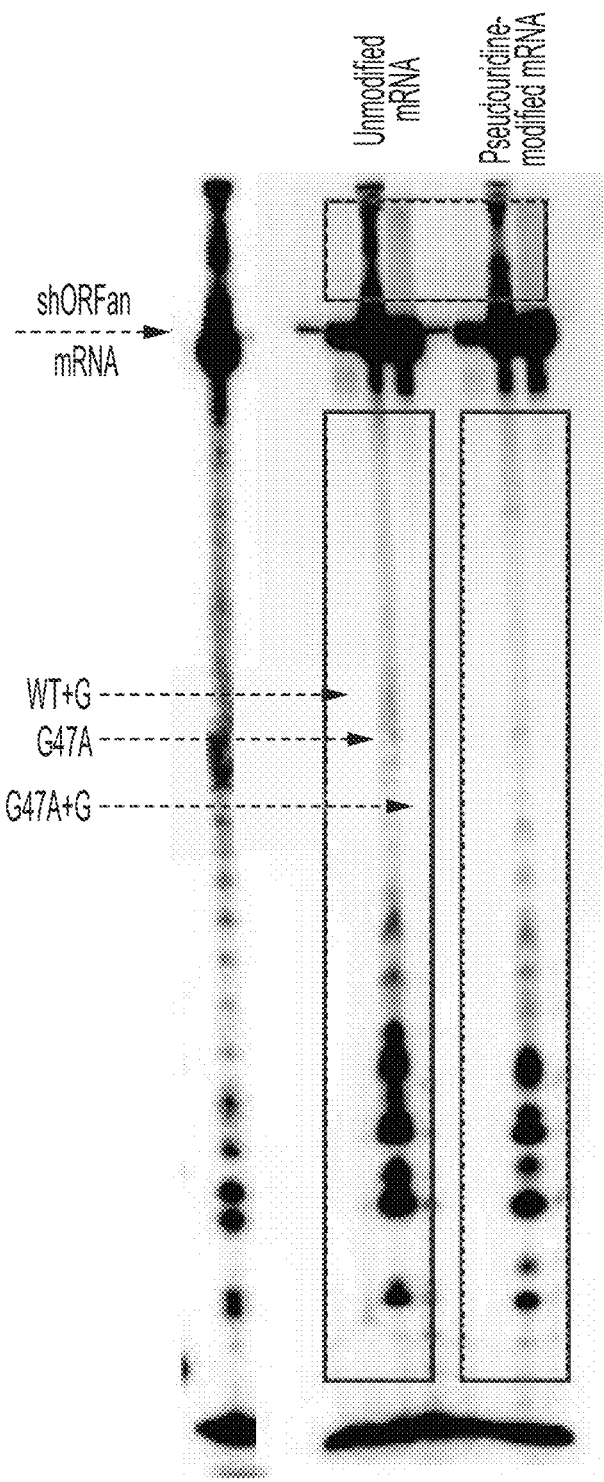
FIGS. 26A-26B show radiolabeled mRNAs produced from IVT reactions containing WT or G47A T7 RNAP variants as indicated, some of which have additional amino acids at the C-terminus. The IVT mRNA products are separated by size on a polyacrylamide denaturing gel.
Figure 26B:

An assay was developed to probe the effect of a foot glycine residue on hEPO mRNA species produced by WT and G47A variant T7 RNAPs. The T7 RNAP enzymes tested were: (1) WT+G (foot glycine), (2) G47A variant, or (3) G47A variant+G (G47A* variant). IVT reactions contained one of the T7 RNAPs listed, shORFan template, NTPs (either unmodified or modified UTP) and $^{32}$P-CTP. Reactions were terminated with EDTA after the desired amount of time. The reaction mixture was then denatured in 4M urea at 95° C. for 5 minutes before being loaded onto a denaturing polyacrylamide gel (20% acrylamide) (FIG. 26A). The gel ran for 30 min at 20 watts and then an additional 2 h at 40 watts. The image was transferred onto a phosphorimager screen (exposure time of 1 h) prior to imaging using the Typhoon scanner. Use of $^{32}$P-CTP labels full-length product (arrow denoting shORFan mRNA), run-on transcription products (box above) (FIG. 26A), and reverse complement mRNA products (FIG. 26A, lower box). The results are also summarized in Table 10 below. These data demonstrate that T7 RNAP with a foot glycine is associated with less contaminating dsRNA than either WT or G47A T7 RNAP (FIG. 26A (lower box) and FIG. 26B). Furthermore, a foot glycine is associated with decreased run-on transcription (FIG. 26A (upper box), FIG. 26B) compared with WT or G47A variant T7 RNAP.

TABLE 10

| Ratio reverse complement (RC): full length (FL) mRNAs | | |
|---|---|---|
| Mutant | RC:FL | Full length (compared to G47A + G) |
| WT + G (Unmodified mRNA) | — | 0.3 |
| G47A (Unmodified mRNA) | 0.16 | 1 |
| G47A + G (G47A*) (Unmodified mRNA) | — | 1 |
| WT + G (Pseudouridine mRNA) | — | 0.2 |
| G47A (Pseudouridine mRNA) | 0.18 | 1.2 |
| G47A + G (Pseudouridine mRNA) | — | 1 |

Example 14. Evaluation of Repeat Dosing of Trinuc-Capped G47A* mRNA Encoding Firefly Luciferase In vitro transcribed mRNA is typically purified, for example, by reverse phase chromatography (RP) to remove cytokine-inducing impurities (dsRNA) and process impurities (e.g., protein/DNA), and to improve total RNA purity. This purification process, however, often results in a significant loss of mRNA product Eliminating RP reduces turn-around-time, eliminates operational and engineering complexity at scale, and is cost saving. Further, because the high temperatures used during RP can hydrolyze a fraction of mRNA, eliminating RP increases mRNA expression levels. Thus, we have developed a mRNA production and purification strategy to eliminate the need for RP. The mRNAs produced by the methods provided in this Example are referred to as "trinuc-capped G47A* mRNAs," which are mRNAs capped with the trinucleotide $GpppA_{2'Ome}pG$ co-transcriptionally in an in vitro transcription assay using the G47A* T7 RNAP variant (having a G47A substitution and an additional C-terminal G).

In this Example, a single 0.5 mpk dose of mRNA encoding firefly luciferase (ffLuc) was formulated in MC3 lipid nanoparticles and administered weekly to C57Bl/6 mice (n=5) for 6 weeks (on Day 1, Day 8, Day 15, Day 22, Day 29, and Day 36). The following mRNAs were administered: (1) unmodified mRNA produced using wild-type T7 polymerase in the presence of equimolar concentrations of NTPs and purified by oligo dT purification (Chemistry A Process 1 dT); (2) pseudouridine-modified mRNA produced using wild-type T7 polymerase in the presence of an excess concentration of GTP/ATP, and purified by reverse phase chromatography (Chemistry B Process 2 RP); (3) pseudouridine-modified mRNA produced using wild-type T7 polymerase in the presence of an excess concentration of GTP/ATP and purified by oligo dT purification (Chemistry B Process 2 dT); (4) pseudouridine-modified mRNA produced using wild-type T7 polymerase in the presence of equimolar concentrations of NTPs and purified by oligo dT purification (Chemistry B process 1 dT); (5) pseudouridine-modified trinuc-capped G47A* mRNA (trinucleotide capped and produced using the G47A* T7 RNAP variant) purified by reverse phase chromatography (Chemistry B Process 3 RP); (6) pseudouridine-modified trinuc-capped G47A* mRNA purified by oligo dT purification (Chemistry B Process 3 dT); and (7) uncapped pseudouridine-modified mRNA produced using the G47A* T7 RNAP variant and purified by oligo dT purification (Chemistry B Process 4 dT)). Six hours following each dose, the following were assessed: serum cytokine levels, mRNA expression, and anti-PEG IgM levels. B cell activation was assessed six hours following the Day 36 dose. Chemistry A denotes use of unmodified uridine triphosphate nucleotide and Chemistry B denotes use of 1-methyl-pseudouridine triphosphate nucleotide. Process 1 refers to equimolar NTPs in the IVT and vaccinia cap1, Process 2 refers to an IVT containing 4:2:1:1 GTP:ATP: CTP:UTP (see WO 2018/053209 A1, published 22 Mar. 2018, incorporated herein by reference in its entirety) and vaccinia cap1, Process 3 refers to equimolar NTPs and GAG in the IVT, and Process 4 refers to equimolar NTPs in the IVT and no cap.

Figures 27A, 27B:
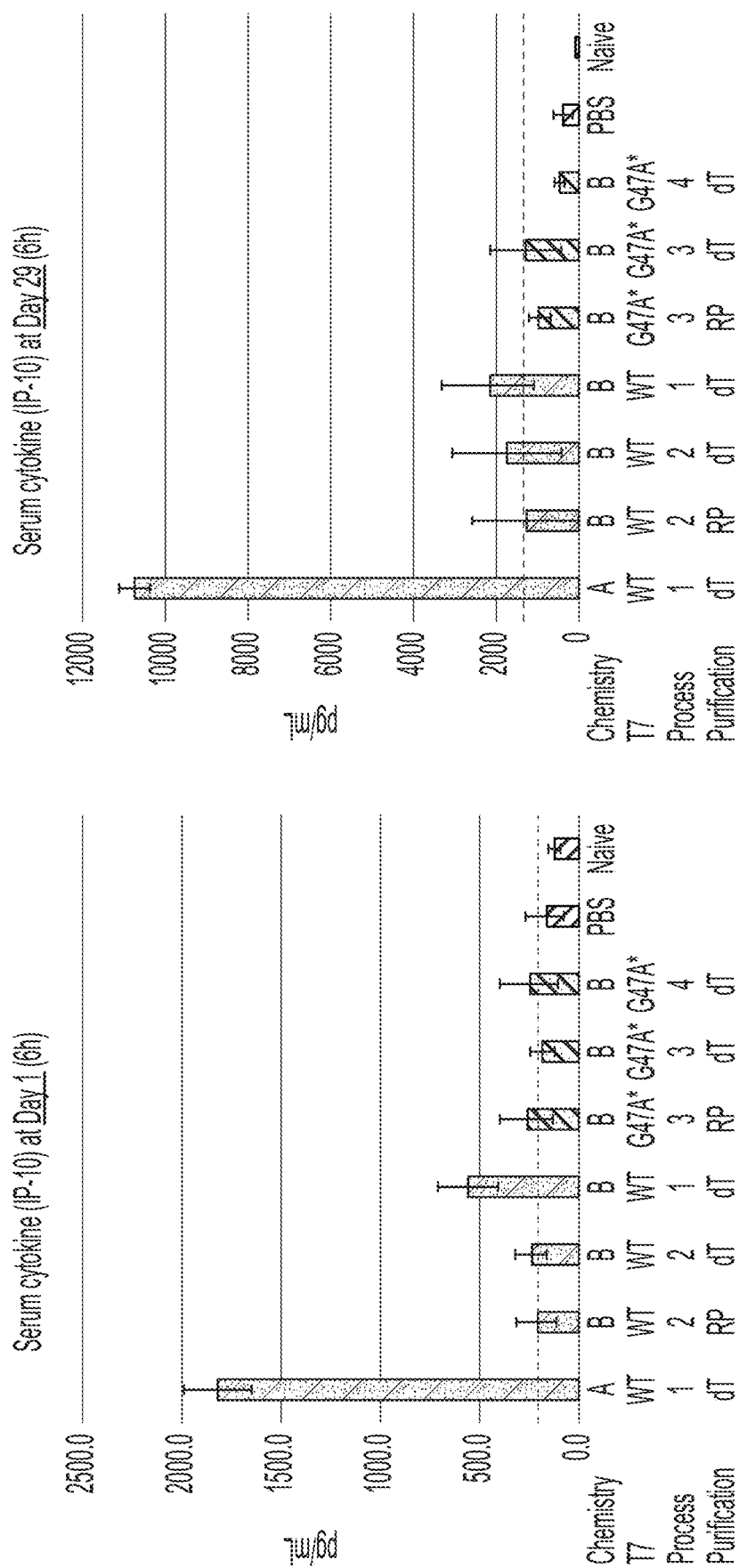
FIGS. 27A and 27B show graphs of data demonstrating that trinuc-capped G47A* mRNAs encoding firefly luciferase (ffLuc) induce IP-10 serum cytokine levels in vivo at Day 1 (FIG. 27A) and Day 29 (FIG. 27B) that are similar to mRNA controls.
Figures 28A, 28B:
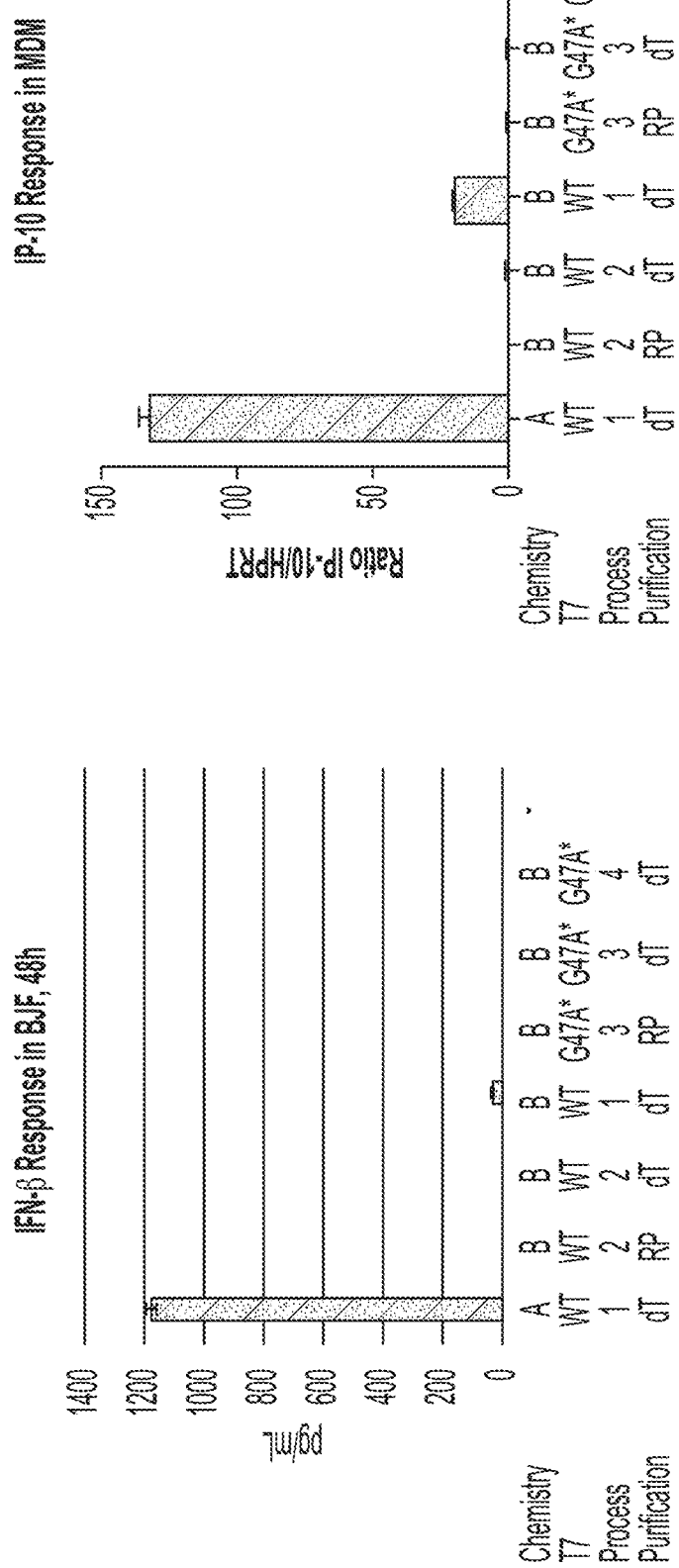
FIGS. 28A and 28B show graphs of data demonstrating that trinuc-capped G47A* mRNAs encoding ffLuc induce baseline cytokine levels in vitro in BJ fibroblasts (BJFs) (FIG. 28A) and in monocyte-derived macrophages (MDMs) (FIG. 28B) that are similar to mRNA controls.

Results from the serum cytokine assessment (IP-10) in mice at Day 1 and Day 29 are presented in FIG. 27A and FIG. 27B, showing that trinuc-capped G47A* mRNAs induce serum cytokine levels in vivo, similar to alpha mRNA controls. The results were similar for in vitro experiments in which the mRNAs were delivered to BJ human fibroblasts (FIG. 28A) and monocyte-derived macrophages (MDMs) (FIG. 28B).

Figure 29:
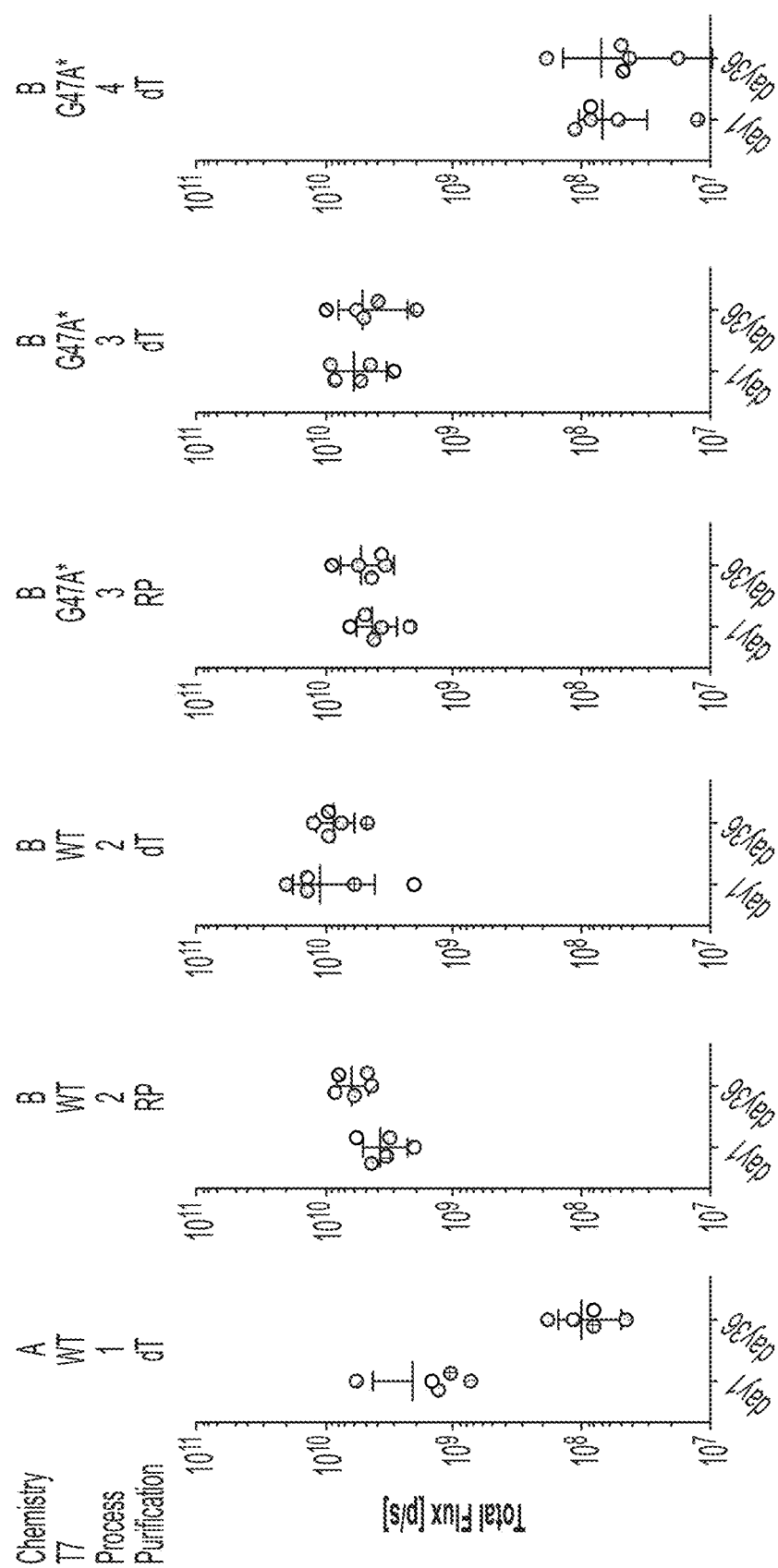
FIG. 29 shows a graph of data demonstrating that trinuc-capped G47A* mRNAs encoding ffLuc maintain high expression in vivo after six (6) weekly doses.

The mRNA expression studies (FIG. 29) showed that trinuc-capped G47A* mRNAs maintained high expression in vivo following 6 weekly doses.

Figure 30:
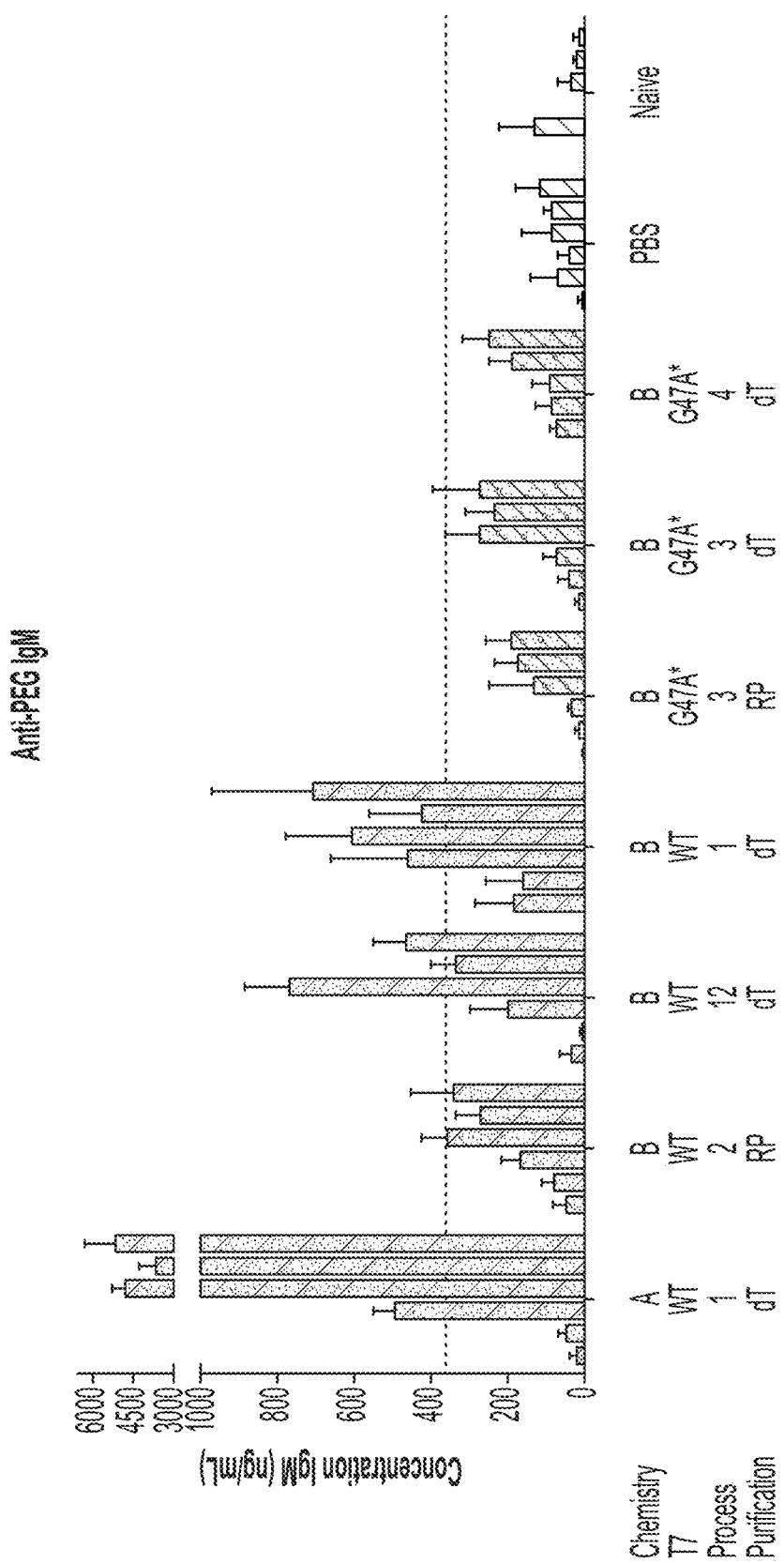
FIG. 30 shows a graph of data demonstrating that trinuc-capped G47A* mRNAs encoding ffLuc induce low anti-PEG IgM levels after six (6) weekly doses.

The anti-PEG IgM assessment (FIG. 30) showed that N1U trinuc-capped G47A* mRNAs produce low anti-PEG IgM levels following 6 weekly doses.

Figure 31:
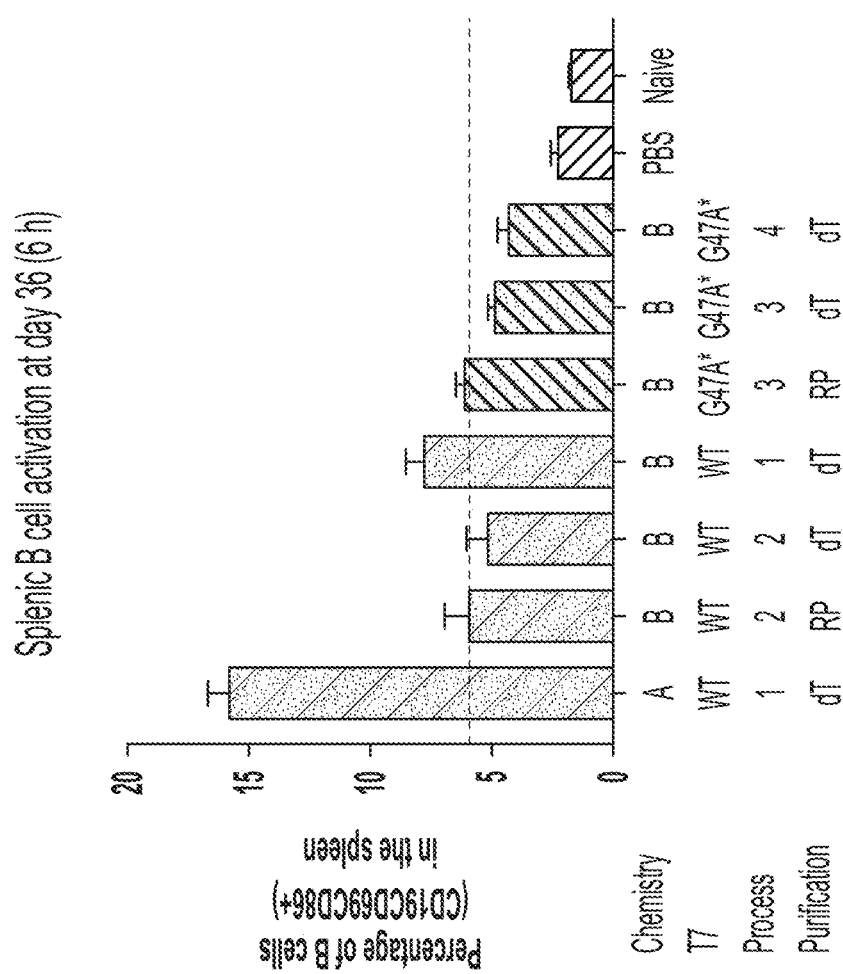
FIG. 31 shows a graph of data demonstrating that trinuc-capped G47A* mRNAs encoding ffLuc exhibit low B cell activation, similar to mRNA controls.

The B cell activation analysis (FIG. 31) showed that activation of splenic B cells transfected with trinuc-capped G47A* mRNAs was low, similar to the alpha mRNA controls.

Collectively, these results indicate that trinuc-capped G47A* mRNAs encoding ffLuc, which are not subjected to RP purification, do not induce a cytokine response above baseline, maintain high expression levels in vivo, maintain low anti-PEG IgM levels in vivo, and exhibit low B cell activation.

Example 15. Evaluation of Repeat Dosing of Trinuc-Capped G47A* mRNA Encoding Human Erythropoietin In this Example, a single 0.5 mpk dose of mRNA encoding human erythropoietin (hEPO) was formulated in MC3 lipid nanoparticles and administered weekly to C57Bl/6 mice (n=5) for 6 weeks (on Day 1, Day 8, Day 15, Day 22, Day 29, and Day 36). The following mRNAs were administered: (1) unmodified mRNA produced using wild-type T7 polymerase in the presence of equimolar concentrations of NTPs and purified by oligo dT purification (Chemistry A Process 1 dT); (2) pseudouridine-modified mRNA produced using wild-type T7 polymerase in the presence of an excess concentration of GTP/ATP and purified by reverse phase chromatography (Chemistry B Process 2 RP); (3) pseudouridine-modified mRNA produced using wild-type T7 polymerase in the presence of an excess concentration of GTP/ATP and purified by oligo dT purification (Chemistry B Process 2 dT); (4) pseudouridine-modified mRNA produced using wild-type T7 polymerase in the presence of equimolar concentrations of NTPs and purified by oligo dT purification (Chemistry B Process 1 dT); (5) pseudouridine-modified trinuc-capped G47A* mRNA (trinucleotide capped and produced using the G47A* T7 RNAP variant) purified by reverse phase chromatography (Chemistry B Process 3 RP); (6) pseudouridine-modified trinuc-capped G47A* mRNA purified by oligo dT purification (Chemistry B Process 3 dT); and (7) uncapped pseudouridine-modified mRNA produced using the G47A* T7 RNAP variant and purified by oligo dT purification (Chemistry B Process 4 dT)). Six hours following each dose, the following were assessed: serum cytokine levels, mRNA expression, and anti-PEG IgM levels. B cell activation was assessed six hours following the Day 36 dose. Chemistry A denotes use of unmodified uridine triphosphate nucleotide and Chemistry B denotes use of 1-methyl-pseudouridine triphosphate nucleotide. Process 1 refers to equimolar NTPs in the IVT and vaccinia cap1, Process 2 refers to an IVT containing 4:2:1:1 GTP:ATP: CTP:UTP and vaccinia cap1, Process 3 refers to equimolar NTPs and GAG in the IVT, and Process 4 refers to equimolar NTPs in the IVT and no cap.

Figure 32A:
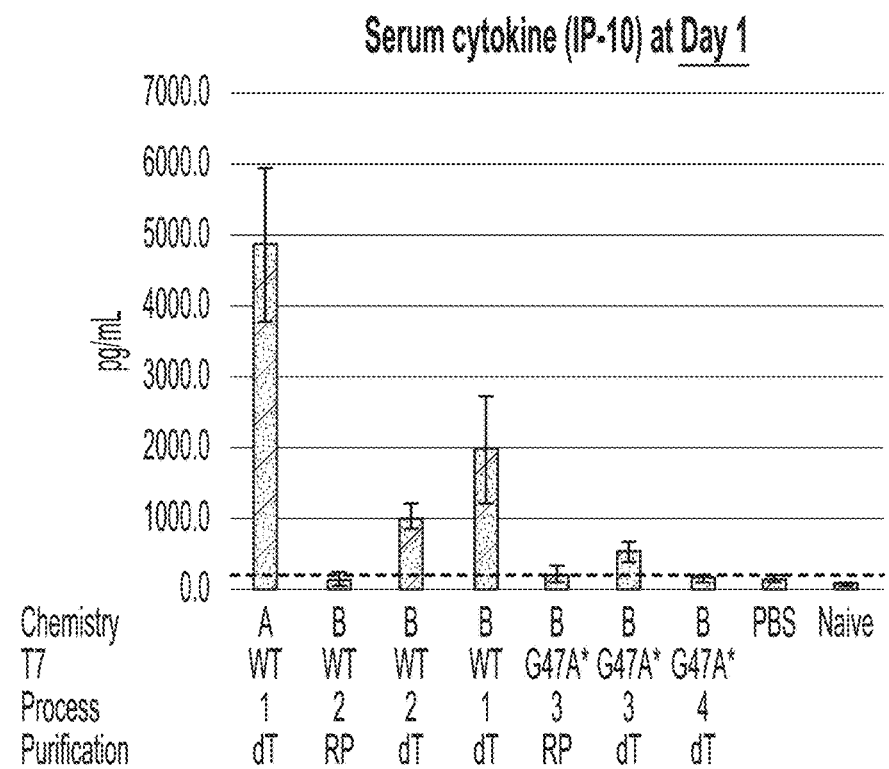
FIGS. 32A and 32B show graphs of data demonstrating that trinuc-capped G47A* mRNAs encoding human erythropoietin (hEPO) induce IP-10 serum cytokine levels in vivo at Day 1 (FIG. 32A) and Day 22 (FIG. 32B) that are similar to mRNA controls.
Figure 32B:
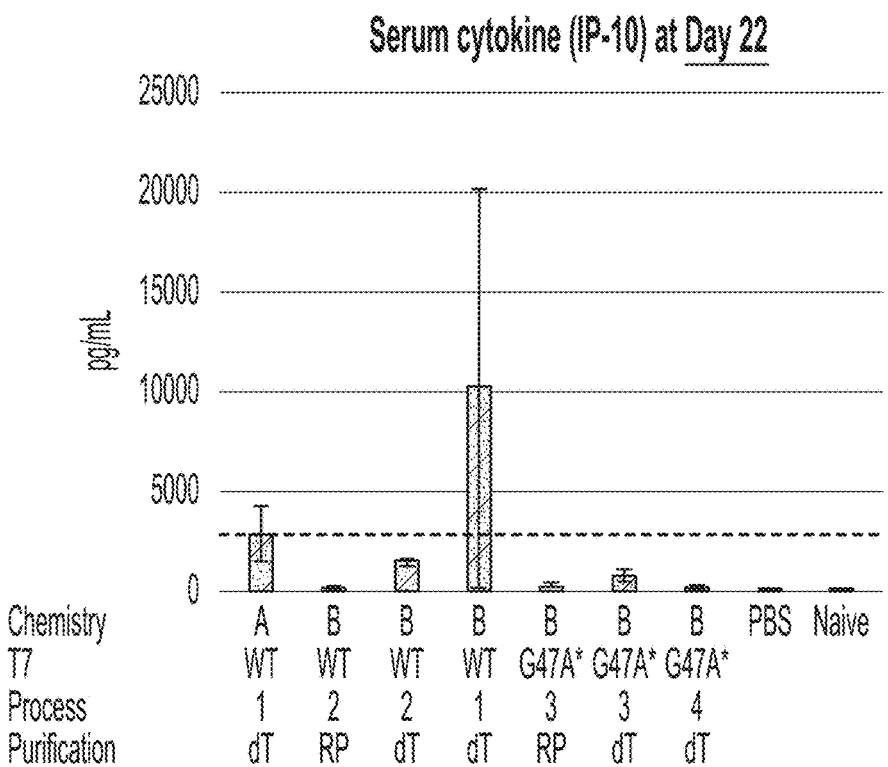
Figure 33A:
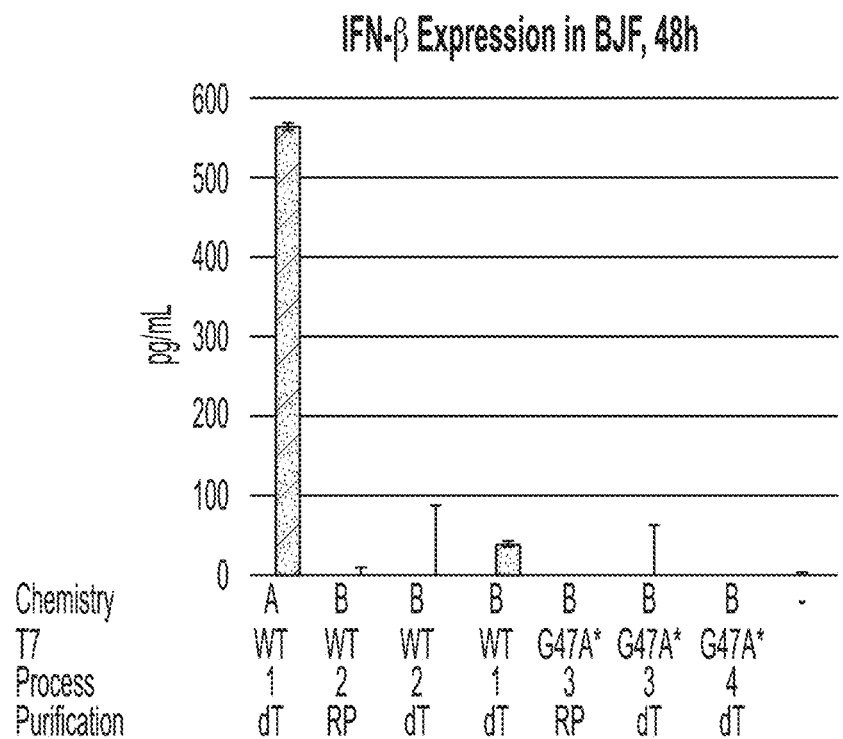
FIGS. 33A and 33B show graphs of data demonstrating that trinuc-capped G47A* mRNAs encoding hEPO induce baseline cytokine levels in vitro in BJ fibroblasts (BJFs) (FIG. 33A) and in monocyte-derived macrophages (MDMs) (FIG. 33B) that are similar to mRNA controls.
Figure 33B:
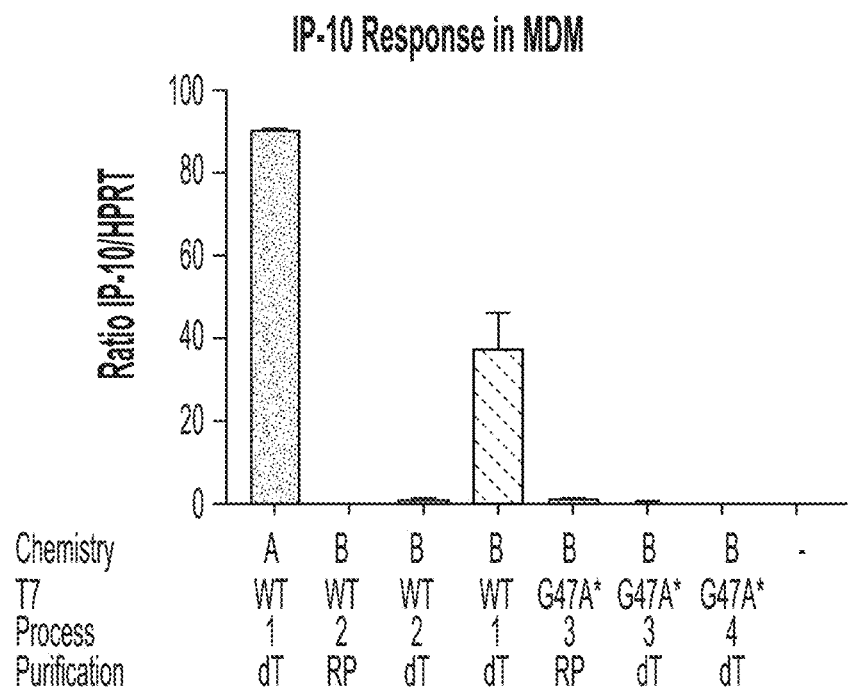

Results from the serum cytokine assessment (IP-10) in mice at Day 1 and Day 22 are presented in FIG. 32A and FIG. 32B, showing that trinuc-capped G47A* mRNAs induce serum cytokine levels in vivo, similar to alpha mRNA controls. The results were similar for in vitro experiments in which the mRNAs were delivered to BJ human fibroblasts (FIG. 33A) and monocyte-derived macrophages (MDMs) (FIG. 33B).

Figure 34:
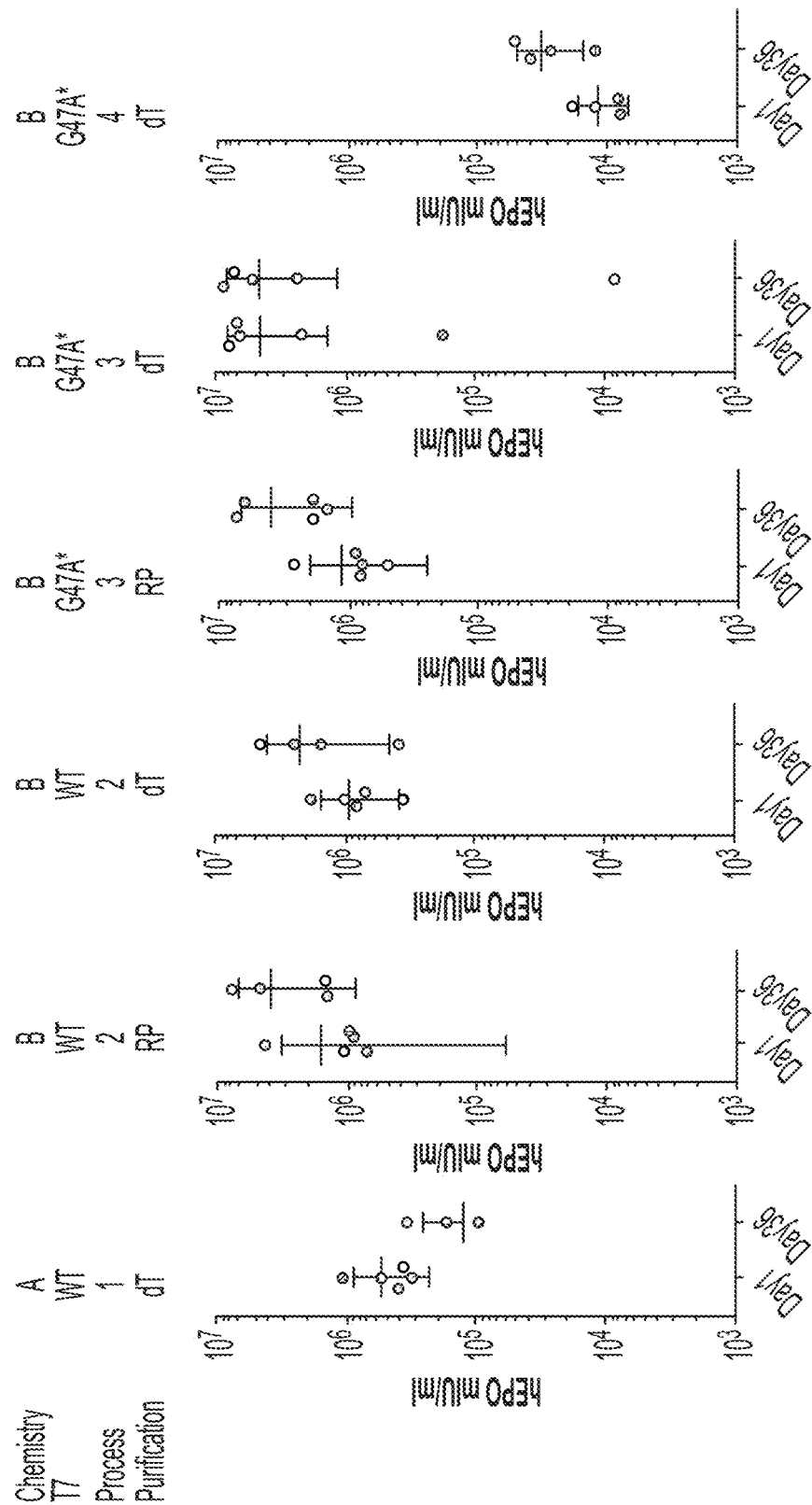
FIG. 34 shows a graph of data demonstrating that trinuc-capped G47A* mRNAs encoding hEPO maintain high expression in vivo after six (6) weekly doses.

The mRNA expression studies (FIG. 34) showed that trinuc-capped G47A* mRNAs maintained high expression in vivo following 6 weekly doses.

Figure 35:
FIG. 35 shows a graph of data demonstrating that trinuc-capped G47A* mRNAs encoding hEPO induce low anti-PEG IgM levels after six (6) weekly doses.

The anti-PEG IgM assessment (FIG. 35) showed that trinuc-capped G47A* mRNAs produce low anti-PEG IgM levels following 6 weekly doses.

Figure 36:
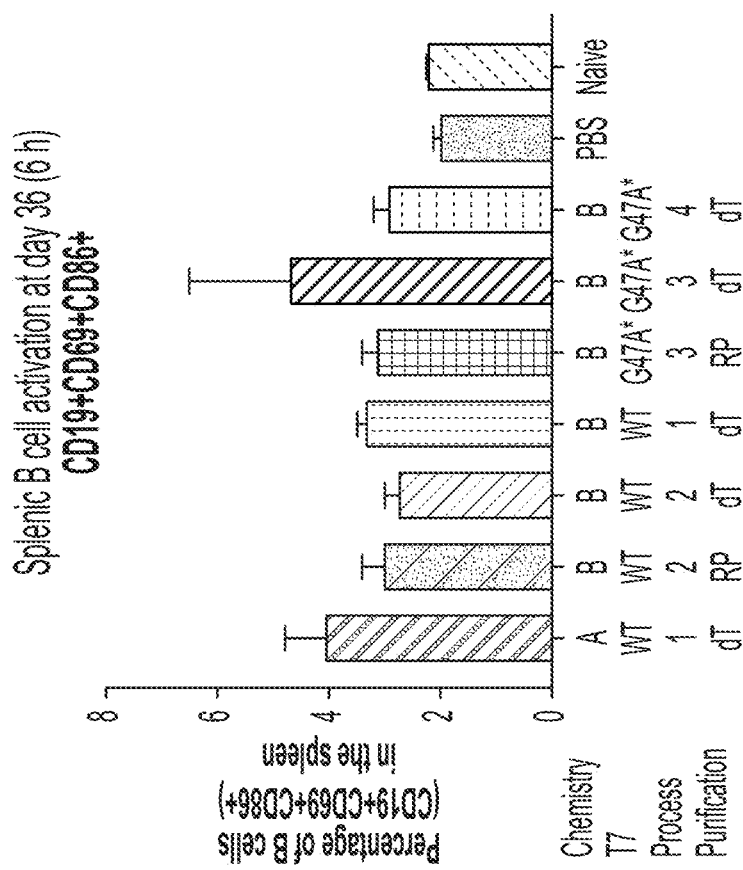
FIG. 36 shows a graph of data demonstrating that trinuc-capped G47A* mRNAs encoding hEPO exhibit low B cell activation, similar to mRNA controls.

The B cell activation analysis (FIG. 36) showed that activation of splenic B cells transfected with trinuc-capped G47A* mRNAs was low, similar to the alpha mRNA controls.

Collectively, these results indicate that trinuc-capped G47A* mRNAs encoding hEPO, which are not subjected to RP purification, do not induce a cytokine response above baseline, maintain high expression levels in vivo, maintain low anti-PEG IgM levels in vivo, and exhibit low B cell activation.

Figure 37B:
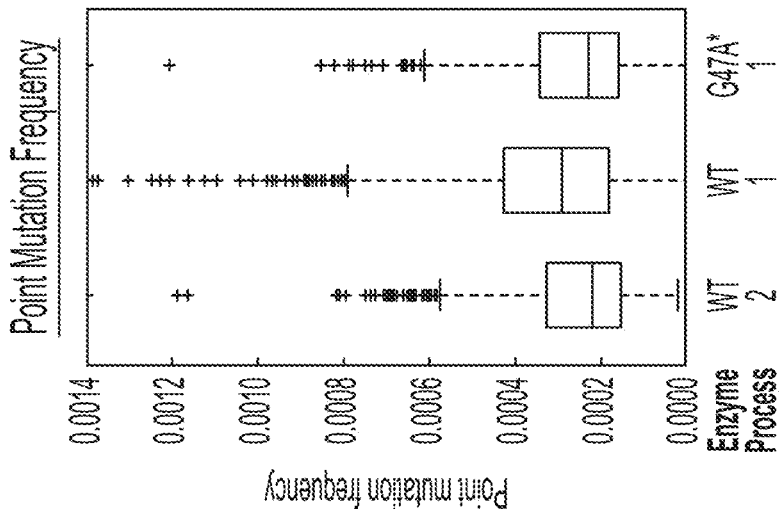
FIGS. 37A and 37B show that the G47A* T7 RNA polymerase variant does not affect indel frequency (FIG. 37A) or point mutation frequency (FIG. 37B).
Figure 37A:
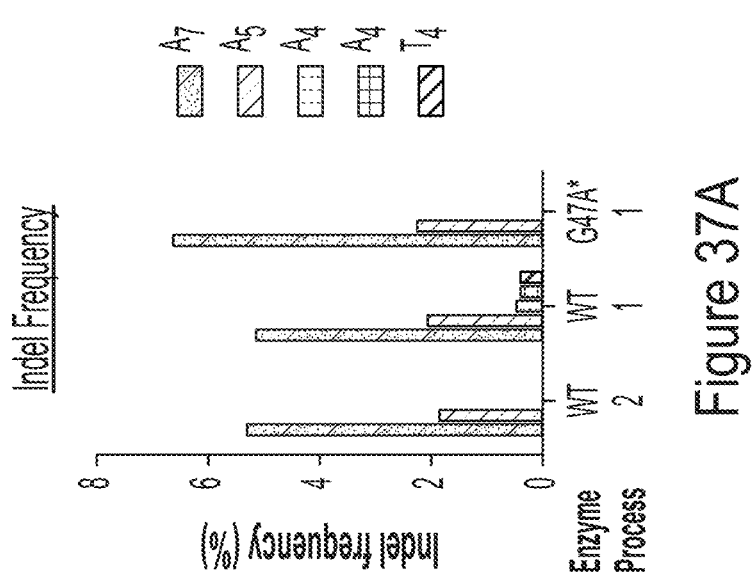

Example 16. Evaluation of Indel Frequency and Point Mutation Frequency mRNAs were prepared with either WT or G47A* enzymes using Process 1 (equimolar NTPs) or Process 2 (4:2:1:1 GTP:ATP:CTP:UTP). For next generation sequencing (NGS), the mRNAs were converted to cDNA by reverse transcriptase and adaptors were ligated to prepare the sequencing library. The NGS data was compared to the parent sequence and any indels observed were tabulated. The indel frequency was comparable for WT and G47A* (FIG. 37A). Likewise, the NGS data was analyzed for any point mutations. The point mutation frequency was comparable for WT and G47A* (FIG. 37B).

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

SEQUENCE LISTING (336 sequences)

SEQ ID NO: 1 - protein, 883 aa, Unknown
  T7 RNA Polymerase
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 2 - protein, 883 aa, Artificial Sequence
  Synthetic Polypeptide
MNTINIAKNDFSDIELAAIPFNTLADHYGERLAREQLALEHEAYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 3 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 4 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATAAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 5 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAAALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 6 - protein, 884 aa, Unknown
  T3 RNA Polymerase
MNIIENIEKNDFSEIELAAIPFNTLADHYGSALAKEQLALEHESYELGERRFLKMLERQAKAGEIADNAAAKPLLATLLPKLTTRIVEWLEEYASKKGRKPSAYAPLQLLKPEASAFITLKVILASLTSTNMTTIQAAAGMLGKAIEDEARFGRIRDLEAKHFKKHVEEQLNKRHGQVYKKAFMQVVEADMIGRGLLGGEAWSSWDKETTMHVGIRLIEMLIESTGLVELQRHNAGNAGSDHEALQLAQEYVDVLAKRAGALAGISPMFQPCVVPPKPWVAITGGGYWANGRRPLALVRTHSKKGLMRYEDVYMPEVYKAVNLAQNTAWKINKKVLAVVNEIVNWKNCPVADIPSLERQELPPKPDDIDTNEAALKEWKKAAAGIYRLDKARVSRRISLEFMLEQANKFASKKAIWFPYNMDWRGRVYAVPMFNPQGNDMTKGLLTLAKGKPIGEEGFYWLKIHGANCAGVDKVPFPERIAFIEKHVDDILACAKDPINNTWWAEQDSPFCFLAFCFEYAGVTHHGLSYNCSLPLAFDGSCSGIQHFSAMLRDEVGGRAVNLLPSETVQDIYGIVAQKVNEILKQDAINGTPNEMITVTDKDTGEISEKLKLGTSTLAQQWLAYGVTRSVTKRSVMTLAYGSKEFGFRQQVLDDTIQPAIDSGKGLMFTQPNQAAGYMAKLIWDAVSVTVVAAVEAMNWLKSAAKLLAAEVKDKKTKEILRHRCAVHWTTPDGFPVWQEYRKPLQKRLDMIFLGQFRLQPTINTLKDSGIDAHKQESGIAPNFVHSQDGSHLRMTVVYAHEKYGIESFALIHDSFGTIPADAGKLFKAVRETMVITYENNDVLADFYSQFADQLHETQLDKMPPLPKKGNLNLQDILKSDFAFA

SEQ ID NO: 7 - protein, 874 aa, Unknown
  SP6 RNA Polymerase
MQDLHAIQLQLEEEMFNGGIRRFEADQQRQIAAGSESDTAWNRRLLSELIAPMAEGIQAYKEEYEGKKGRAPRALAFLQCVENEVAAYITMKVVMDMLNTDATLQAIAMSVAERIEDQVRFSKLEGHAAKYFEKVKKSLKASRTKSYRHAHNVAVVAEKSVAEKDADFDRWEAWPKETQLQIGTTLLEILEGSVFYNGEPVFMRAMRTYGGKTIYYLQTSESVGQWISAFKEHVAQLSPAYAPCVIPPRPWRTPFNGGFHTEKVASRIRLVKGNREHVRKLTQKQMPKVYKAINALQNTQWQINKDVLAVIEEVIRLDLGYGVPSFKPLIDKENKPANPVPVEFQHLRGRELKEMLSPEQWQQFINWKGECARLYTAETKRGSKSAAVVRMVGQARKYSAFESIYFVYAMDSRSRVYVQSSTLSPQSNDLGKALLRFTEGRPVNGVEALKWFCINGANLWGWDKKTFDVRVSNVLDEEFQDMCRDIAADPLTFTQWAKADAPYEFLAWCFEYAQYLDLVDEGRADEFRTHLPVHQDGSCSGIQHYSAMLRDEVGAKAVNLKPSDAPQDIYGAVAQVVIKKNALYMDADDATTFTSGSVTLSGTELRAMASAWDSIGITRSLTKKPVMTLPYGSTRLTCRESVIDYIVDLEEKEAQKAVAEGRTANKVHPFEDDRQDYLTPGAAYNYMTALIWPSISEVVKAPIVAMKMIRQLARFAAKRNEGLMYTLPTGFILEQKIMATEMLRVRTCLMGDIKMSLQVETDIVDEAAMMGAAAPNFVHGHDASHLILTVCELVDKGVTSIAVIHDSFGTHADNTLTLRVALKGQMVAMYIDGNALQKLLEEHEVRWMVDTGIEVPEQGEFDLNEIMDSEYVFA

SEQ ID NO: 8 - protein, 906 aa, Unknown
  K11  RNA Polymerase
MNALNIGRNDFSEIELAAIPYNILSEHYGDQAAREQLALEHEAYELGRQRFLKMLERQVKAGEFADNAAAKPLVLTLHPQLTKRIDDWKEEQANARGKKPRAYYPIKHGVASELAVSMGAEVLKEKRGVSSEAIALLTIKVVLGNAHRPLKGHNPAVSSQLGKALEDEARFGRIREQEAAYFKKNVADQLDKRVGHVYKKAFMQVVEADMISKGMLGGDNWASWKTDEQMHVGTKLLELLIEGTGLVEMTKNKMADGSDDVTSMQMVQLAPAFVELLSKRAGALAGISPMHQPCVVPPKPWVETVGGGYWSVGRRPLALVRTHSKKALRRYADVHMPEVYKAVNLAQNTPWKVNKKVLAVVNEIVNWKHCPVGDVPAIEREELPPRPDDIDTNEVARKAWRKEAAAVYRKDKARQSRRCRCEFMVAQANKFANHKAIWFPYNMDWRGRVYAVSMFNPQGNDMTKGSLTLAKGKPIGLDGFYWLKIHGANCAGVDKVPFPERIKFIEENEGNILASAADPLNNTWWTQQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFHEKVTLGESVLAAQWLQYGVTRKVTKRSVMTLAYGSKESLVRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYRKQNQARLKLVFLGQANVKMTYNTGKDSEIDAHKQESGIAPNFVHSQDGSHLRMTVVHANEVYGIDSFALIHDSSGTIPADAGNLFKAVRETMVKTYEDNDVIADFYDQFADQLHESQLDKMPAVPAKGDLNLRDILESDFAFA

SEQ ID NO: 9 - protein, 883 aa, Artificial Sequence
  Synthetic Polypeptide
MNTINIAKNDFSDIELAAIPFNTLADHYGERLAREQLALEHASYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 10 - protein, 883 aa, Artificial Sequence
  Synthetic Polypeptide
MNTINIAKNDFSDIELAAIPFNTLADHYGERLAREQLALEHISYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 11 - protein, 883 aa, Artificial Sequence
  Synthetic Polypeptide
MNTINIAKNDFSDIELAAIPFNTLADHYGERLAREQLALEHLSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 12 - protein, 883 aa, Artificial Sequence
  Synthetic Polypeptide
MNTINIAKNDFSDIELAAIPFNTLADHYGERLAREQLALEHMSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 13 - protein, 883 aa, Artificial Sequence
  Synthetic Polypeptide
MNTINIAKNDFSDIELAAIPFNTLADHYGERLAREQLALEHKSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 14 - protein, 883 aa, Artificial Sequence
  Synthetic Polypeptide
MNTINIAKNDFSDIELAAIPFNTLADHYGERLAREQLALEHQSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 15 - protein, 883 aa, Artificial Sequence
  Synthetic Polypeptide
MNTINIAKNDFSDIELAAIPFNTLADHYGERLAREQLALEHEIYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 16 - protein, 883 aa, Artificial Sequence
  Synthetic Polypeptide
MNTINIAKNDFSDIELAAIPFNTLADHYGERLAREQLALEHELYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 17 - protein, 883 aa, Artificial Sequence
  Synthetic Polypeptide
MNTINIAKNDFSDIELAAIPFNTLADHYGERLAREQLALEHEMYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 18 - protein, 883 aa, Artificial Sequence
  Synthetic Polypeptide
MNTINIAKNDFSDIELAAIPFNTLADHYGERLAREQLALEHEKYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 19 - protein, 883 aa, Artificial Sequence
  Synthetic Polypeptide
MNTINIAKNDFSDIELAAIPFNTLADHYGERLAREQLALEHEQYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 20 - protein, 883 aa, Artificial Sequence
  Synthetic Polypeptide
MNTINIAKNDFSDIELAAIPFNTLADHYGERLAREQLALEHEEYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 21 - protein, 883 aa, Artificial Sequence
  Synthetic Polypeptide
MNTINIAKNDFSDIELAAIPFNTLADHYGERLAREQLALEHESAEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 22 - protein, 883 aa, Artificial Sequence
  Synthetic Polypeptide
MNTINIAKNDFSDIELAAIPFNTLADHYGERLAREQLALEHESIEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 23 - protein, 883 aa, Artificial Sequence
  Synthetic Polypeptide
MNTINIAKNDFSDIELAAIPFNTLADHYGERLAREQLALEHESLEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 24 - protein, 883 aa, Artificial Sequence
  Synthetic Polypeptide
MNTINIAKNDFSDIELAAIPFNTLADHYGERLAREQLALEHESMEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 25 - protein, 883 aa, Artificial Sequence
  Synthetic Polypeptide
MNTINIAKNDFSDIELAAIPFNTLADHYGERLAREQLALEHESKEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 26 - protein, 883 aa, Artificial Sequence
  Synthetic Polypeptide
MNTINIAKNDFSDIELAAIPFNTLADHYGERLAREQLALEHESQEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 27 - protein, 883 aa, Artificial Sequence
  Synthetic Polypeptide
MNTINIAKNDFSDIELAAIPFNTLADHYGERLAREQLALEHESEEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 28 - protein, 883 aa, Artificial Sequence
  Synthetic Polypeptide
MNTINIAKNDFSDIELAAIPFNTLADHYGERLAREQLALEHESYAMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 29 - protein, 883 aa, Artificial Sequence
  Synthetic Polypeptide
MNTINIAKNDFSDIELAAIPFNTLADHYGERLAREQLALEHESYIMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 30 - protein, 883 aa, Artificial Sequence
  Synthetic Polypeptide
MNTINIAKNDFSDIELAAIPFNTLADHYGERLAREQLALEHESYLMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 31 - protein, 883 aa, Artificial Sequence
  Synthetic Polypeptide
MNTINIAKNDFSDIELAAIPFNTLADHYGERLAREQLALEHESYMMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 32 - protein, 883 aa, Artificial Sequence
  Synthetic Polypeptide
MNTINIAKNDFSDIELAAIPFNTLADHYGERLAREQLALEHESYKMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 33 - protein, 883 aa, Artificial Sequence
  Synthetic Polypeptide
MNTINIAKNDFSDIELAAIPFNTLADHYGERLAREQLALEHESYQMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 34 - protein, 883 aa, Artificial Sequence
  Synthetic Polypeptide
MNTINIAKNDFSDIELAAIPFNTLADHYGERLAREQLALEHESYEAGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 35 - protein, 883 aa, Artificial Sequence
  Synthetic Polypeptide
MNTINIAKNDFSDIELAAIPFNTLADHYGERLAREQLALEHESYEIGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 36 - protein, 883 aa, Artificial Sequence
  Synthetic Polypeptide
MNTINIAKNDFSDIELAAIPFNTLADHYGERLAREQLALEHESYELGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 37 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAAAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 38 - protein, 883 aa, Artificial Sequence
  Synthetic Polypeptide
MNTINIAKNDFSDIELAAIPFNTLADHYGERLAREQLALEHESYEKGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 39 - protein, 883 aa, Artificial Sequence
  Synthetic Polypeptide
MNTINIAKNDFSDIELAAIPFNTLADHYGERLAREQLALEHESYEQGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 40 - protein, 883 aa, Artificial Sequence
  Synthetic Polypeptide
MNTINIAKNDFSDIELAAIPFNTLADHYGERLAREQLALEHESYEEGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 41 - protein, 883 aa, Artificial Sequence
  Synthetic Polypeptide
MNTINIAKNDFSDIELAAIPFNTLADHYGERLAREQLALEHESYEMIEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 42 - protein, 883 aa, Artificial Sequence
  Synthetic Polypeptide
MNTINIAKNDFSDIELAAIPFNTLADHYGERLAREQLALEHESYEMLEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 43 - protein, 883 aa, Artificial Sequence
  Synthetic Polypeptide
MNTINIAKNDFSDIELAAIPFNTLADHYGERLAREQLALEHESYEMMEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 44 - protein, 883 aa, Artificial Sequence
  Synthetic Polypeptide
MNTINIAKNDFSDIELAAIPFNTLADHYGERLAREQLALEHESYEMKEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 45 - protein, 883 aa, Artificial Sequence
  Synthetic Polypeptide
MNTINIAKNDFSDIELAAIPFNTLADHYGERLAREQLALEHESYEMQEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 46 - protein, 883 aa, Artificial Sequence
  Synthetic Polypeptide
MNTINIAKNDFSDIELAAIPFNTLADHYGERLAREQLALEHESYEMEEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 47 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATIAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 48 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATLAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 49 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATMAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 50 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATKAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 51 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATQAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 52 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATEAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 53 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRIGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 54 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRLGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 55 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRMGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 56 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRKGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 57 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRQGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 58 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATREGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 59 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAIALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 60 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRALALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 61 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAMALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 62 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAKALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 63 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAQALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 64 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAEALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 65 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGILAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 66 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGLLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 67 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGMLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 68 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGKLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 69 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGQLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 70 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGELAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 71 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAAAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 72 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAIAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 73 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAMAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 74 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAKAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 75 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAQAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 76 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAEAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 77 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALIGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 78 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALLGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 79 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALMGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 80 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALKGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 81 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALQGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 82 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALEGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 83 - protein, 883 aa, Artificial Sequence
  Synthetic Polypeptide
MNTINIAKNDFSDIELAAIPFNTLADHYGERLAREQLALEHERYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 84 - protein, 883 aa, Artificial Sequence
  Synthetic Polypeptide
MNTINIAKNDFSDIELAAIPFNTLADHYGERLAREQLALEHESYRMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 85 - protein, 883 aa, Artificial Sequence
  Synthetic Polypeptide
MNTINIAKNDFSDIELAAIPFNTLADHYGERLAREQLALEHESYEMREARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 86 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATWAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 87 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRARALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 88 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGRLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 89 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKWVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 90 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVMEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 91 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVNEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 92 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEIQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 93 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVETQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 94 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEVQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 95 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKFFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 96 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKWFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 97 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMMVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 98 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVFADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 99 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 100 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 101 - protein, 889 aa, Artificial Sequence
  Synthetic Polypeptide
  misc_feature (885)..(889): Xaa can be any naturally occurring amino acid
  MISC_FEATURE (886)..(889): may be absent
MNIIENIEKNDFSEIELAAIPFNTLADHYGSALAKEQLALEHESYELGERRFLKMLERQAKAGEIADNAAAKPLLATLLPKLTTRIVEWLEEYASKKGRKPSAYAPLQLLKPEASAFITLKVILASLTSTNMTTIQAAAGMLGKAIEDEARFGRIRDLEAKHFKKHVEEQLNKRHGQVYKKAFMQVVEADMIGRGLLGGEAWSSWDKETTMHVGIRLIEMLIESTGLVELQRHNAGNAGSDHEALQLAQEYVDVLAKRAGALAGISPMFQPCVVPPKPWVAITGGGYWANGRRPLALVRTHSKKGLMRYEDVYMPEVYKAVNLAQNTAWKINKKVLAVVNEIVNWKNCPVADIPSLERQELPPKPDDIDTNEAALKEWKKAAAGIYRLDKARVSRRISLEFMLEQANKFASKKAIWFPYNMDWRGRVYAVPMFNPQGNDMTKGLLTLAKGKPIGEEGFYWLKIHGANCAGVDKVPFPERIAFIEKHVDDILACAKDPINNTWWAEQDSPFCFLAFCFEYAGVTHHGLSYNCSLPLAFDGSCSGIQHFSAMLRDEVGGRAVNLLPSETVQDIYGIVAQKVNEILKQDAINGTPNEMITVTDKDTGEISEKLKLGTSTLAQQWLAYGVTRSVTKRSVMTLAYGSKEFGFRQQVLDDTIQPAIDSGKGLMFTQPNQAAGYMAKLIWDAVSVTVVAAVEAMNWLKSAAKLLAAEVKDKKTKEILRHRCAVHWTTPDGFPVWQEYRKPLQKRLDMIFLGQFRLQPTINTLKDSGIDAHKQESGIAPNFVHSQDGSHLRMTVVYAHEKYGIESFALIHDSFGTIPADAGKLFKAVRETMVITYENNDVLADFYSQFADQLHETQLDKMPPLPKKGNLNLQDILKSDFAFAXXXXX

SEQ ID NO: 102 - protein, 885 aa, Artificial Sequence
  Synthetic Polypeptide
MNIIENIEKNDFSEIELAAIPFNTLADHYGSALAKEQLALEHESYELGERRFLKMLERQAKAGEIADNAAAKPLLATLLPKLTTRIVEWLEEYASKKGRKPSAYAPLQLLKPEASAFITLKVILASLTSTNMTTIQAAAGMLGKAIEDEARFGRIRDLEAKHFKKHVEEQLNKRHGQVYKKAFMQVVEADMIGRGLLGGEAWSSWDKETTMHVGIRLIEMLIESTGLVELQRHNAGNAGSDHEALQLAQEYVDVLAKRAGALAGISPMFQPCVVPPKPWVAITGGGYWANGRRPLALVRTHSKKGLMRYEDVYMPEVYKAVNLAQNTAWKINKKVLAVVNEIVNWKNCPVADIPSLERQELPPKPDDIDTNEAALKEWKKAAAGIYRLDKARVSRRISLEFMLEQANKFASKKAIWFPYNMDWRGRVYAVPMFNPQGNDMTKGLLTLAKGKPIGEEGFYWLKIHGANCAGVDKVPFPERIAFIEKHVDDILACAKDPINNTWWAEQDSPFCFLAFCFEYAGVTHHGLSYNCSLPLAFDGSCSGIQHFSAMLRDEVGGRAVNLLPSETVQDIYGIVAQKVNEILKQDAINGTPNEMITVTDKDTGEISEKLKLGTSTLAQQWLAYGVTRSVTKRSVMTLAYGSKEFGFRQQVLDDTIQPAIDSGKGLMFTQPNQAAGYMAKLIWDAVSVTVVAAVEAMNWLKSAAKLLAAEVKDKKTKEILRHRCAVHWTTPDGFPVWQEYRKPLQKRLDMIFLGQFRLQPTINTLKDSGIDAHKQESGIAPNFVHSQDGSHLRMTVVYAHEKYGIESFALIHDSFGTIPADAGKLFKAVRETMVITYENNDVLADFYSQFADQLHETQLDKMPPLPKKGNLNLQDILKSDFAFAG

SEQ ID NO: 103 - protein, 879 aa, Artificial Sequence
  Synthetic Polypeptide
  misc_feature (875)..(879): Xaa can be any naturally occurring amino acid
  MISC_FEATURE (876)..(879): may be absent
MQDLHAIQLQLEEEMFNGGIRRFEADQQRQIAAGSESDTAWNRRLLSELIAPMAEGIQAYKEEYEGKKGRAPRALAFLQCVENEVAAYITMKVVMDMLNTDATLQAIAMSVAERIEDQVRFSKLEGHAAKYFEKVKKSLKASRTKSYRHAHNVAVVAEKSVAEKDADFDRWEAWPKETQLQIGTTLLEILEGSVFYNGEPVFMRAMRTYGGKTIYYLQTSESVGQWISAFKEHVAQLSPAYAPCVIPPRPWRTPFNGGFHTEKVASRIRLVKGNREHVRKLTQKQMPKVYKAINALQNTQWQINKDVLAVIEEVIRLDLGYGVPSFKPLIDKENKPANPVPVEFQHLRGRELKEMLSPEQWQQFINWKGECARLYTAETKRGSKSAAVVRMVGQARKYSAFESIYFVYAMDSRSRVYVQSSTLSPQSNDLGKALLRFTEGRPVNGVEALKWFCINGANLWGWDKKTFDVRVSNVLDEEFQDMCRDIAADPLTFTQWAKADAPYEFLAWCFEYAQYLDLVDEGRADEFRTHLPVHQDGSCSGIQHYSAMLRDEVGAKAVNLKPSDAPQDIYGAVAQVVIKKNALYMDADDATTFTSGSVTLSGTELRAMASAWDSIGITRSLTKKPVMTLPYGSTRLTCRESVIDYIVDLEEKEAQKAVAEGRTANKVHPFEDDRQDYLTPGAAYNYMTALIWPSISEVVKAPIVAMKMIRQLARFAAKRNEGLMYTLPTGFILEQKIMATEMLRVRTCLMGDIKMSLQVETDIVDEAAMMGAAAPNFVHGHDASHLILTVCELVDKGVTSIAVIHDSFGTHADNTLTLRVALKGQMVAMYIDGNALQKLLEEHEVRWMVDTGIEVPEQGEFDLNEIMDSEYVFAXXXXX

SEQ ID NO: 104 - protein, 875 aa, Artificial Sequence
  Synthetic Polypeptide
MQDLHAIQLQLEEEMFNGGIRRFEADQQRQIAAGSESDTAWNRRLLSELIAPMAEGIQAYKEEYEGKKGRAPRALAFLQCVENEVAAYITMKVVMDMLNTDATLQAIAMSVAERIEDQVRFSKLEGHAAKYFEKVKKSLKASRTKSYRHAHNVAVVAEKSVAEKDADFDRWEAWPKETQLQIGTTLLEILEGSVFYNGEPVFMRAMRTYGGKTIYYLQTSESVGQWISAFKEHVAQLSPAYAPCVIPPRPWRTPFNGGFHTEKVASRIRLVKGNREHVRKLTQKQMPKVYKAINALQNTQWQINKDVLAVIEEVIRLDLGYGVPSFKPLIDKENKPANPVPVEFQHLRGRELKEMLSPEQWQQFINWKGECARLYTAETKRGSKSAAVVRMVGQARKYSAFESIYFVYAMDSRSRVYVQSSTLSPQSNDLGKALLRFTEGRPVNGVEALKWFCINGANLWGWDKKTFDVRVSNVLDEEFQDMCRDIAADPLTFTQWAKADAPYEFLAWCFEYAQYLDLVDEGRADEFRTHLPVHQDGSCSGIQHYSAMLRDEVGAKAVNLKPSDAPQDIYGAVAQVVIKKNALYMDADDATTFTSGSVTLSGTELRAMASAWDSIGITRSLTKKPVMTLPYGSTRLTCRESVIDYIVDLEEKEAQKAVAEGRTANKVHPFEDDRQDYLTPGAAYNYMTALIWPSISEVVKAPIVAMKMIRQLARFAAKRNEGLMYTLPTGFILEQKIMATEMLRVRTCLMGDIKMSLQVETDIVDEAAMMGAAAPNFVHGHDASHLILTVCELVDKGVTSIAVIHDSFGTHADNTLTLRVALKGQMVAMYIDGNALQKLLEEHEVRWMVDTGIEVPEQGEFDLNEIMDSEYVFAG

SEQ ID NO: 105 - protein, 911 aa, Artificial Sequence
  Synthetic Polypeptide
  misc_feature (907)..(911): Xaa can be any naturally occurring amino acid
  MISC_FEATURE (908)..(911): may be absent
MNALNIGRNDFSEIELAAIPYNILSEHYGDQAAREQLALEHEAYELGRQRFLKMLERQVKAGEFADNAAAKPLVLTLHPQLTKRIDDWKEEQANARGKKPRAYYPIKHGVASELAVSMGAEVLKEKRGVSSEAIALLTIKVVLGNAHRPLKGHNPAVSSQLGKALEDEARFGRIREQEAAYFKKNVADQLDKRVGHVYKKAFMQVVEADMISKGMLGGDNWASWKTDEQMHVGTKLLELLIEGTGLVEMTKNKMADGSDDVTSMQMVQLAPAFVELLSKRAGALAGISPMHQPCVVPPKPWVETVGGGYWSVGRRPLALVRTHSKKALRRYADVHMPEVYKAVNLAQNTPWKVNKKVLAVVNEIVNWKHCPVGDVPAIEREELPPRPDDIDTNEVARKAWRKEAAAVYRKDKARQSRRCRCEFMVAQANKFANHKAIWFPYNMDWRGRVYAVSMFNPQGNDMTKGSLTLAKGKPIGLDGFYWLKIHGANCAGVDKVPFPERIKFIEENEGNILASAADPLNNTWWTQQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFHEKVTLGESVLAAQWLQYGVTRKVTKRSVMTLAYGSKESLVRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYRKQNQARLKLVFLGQANVKMTYNTGKDSEIDAHKQESGIAPNFVHSQDGSHLRMTVVHANEVYGIDSFALIHDSSGTIPADAGNLFKAVRETMVKTYEDNDVIADFYDQFADQLHESQLDKMPAVPAKGDLNLRDILESDFAFAXXXXX

SEQ ID NO: 106 - protein, 907 aa, Artificial Sequence
  Synthetic Polypeptide
MNALNIGRNDFSEIELAAIPYNILSEHYGDQAAREQLALEHEAYELGRQRFLKMLERQVKAGEFADNAAAKPLVLTLHPQLTKRIDDWKEEQANARGKKPRAYYPIKHGVASELAVSMGAEVLKEKRGVSSEAIALLTIKVVLGNAHRPLKGHNPAVSSQLGKALEDEARFGRIREQEAAYFKKNVADQLDKRVGHVYKKAFMQVVEADMISKGMLGGDNWASWKTDEQMHVGTKLLELLIEGTGLVEMTKNKMADGSDDVTSMQMVQLAPAFVELLSKRAGALAGISPMHQPCVVPPKPWVETVGGGYWSVGRRPLALVRTHSKKALRRYADVHMPEVYKAVNLAQNTPWKVNKKVLAVVNEIVNWKHCPVGDVPAIEREELPPRPDDIDTNEVARKAWRKEAAAVYRKDKARQSRRCRCEFMVAQANKFANHKAIWFPYNMDWRGRVYAVSMFNPQGNDMTKGSLTLAKGKPIGLDGFYWLKIHGANCAGVDKVPFPERIKFIEENEGNILASAADPLNNTWWTQQDSPFCFLAFCFEYAGVKHHGLNYNCSLPLAFDGSCSGIQHFSAMLRDSIGGRAVNLLPSDTVQDIYKIVADKVNEVLHQHAVNGSQTVVEQIADKETGEFHEKVTLGESVLAAQWLQYGVTRKVTKRSVMTLAYGSKESLVRQQVLEDTIQPAIDNGEGLMFTHPNQAAGYMAKLIWDAVTVTVVAAVEAMNWLKSAAKLLAAEVKDKKTKEVLRKRCAIHWVTPDGFPVWQEYRKQNQARLKLVFLGQANVKMTYNTGKDSEIDAHKQESGIAPNFVHSQDGSHLRMTVVHANEVYGIDSFALIHDSSGTIPADAGNLFKAVRETMVKTYEDNDVIADFYDQFADQLHESQLDKMPAVPAKGDLNLRDILESDFAFAG

SEQ ID NO: 107 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHEAYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 108 - protein, 884 aa, Artificial Sequence
  Synthetic Polypeptide
MNTINIAKNDFSDIELAAIPFNTLADHYGERLAREQLALEHEAYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 109 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 110 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 111 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATAAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 112 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATAAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 113 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAAALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 114 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAAALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 115 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHASYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 116 - protein, 884 aa, Artificial Sequence
  Synthetic Polypeptide
MNTINIAKNDFSDIELAAIPFNTLADHYGERLAREQLALEHASYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 117 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHISYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 118 - protein, 884 aa, Artificial Sequence
  Synthetic Polypeptide
MNTINIAKNDFSDIELAAIPFNTLADHYGERLAREQLALEHISYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 119 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHLSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 120 - protein, 884 aa, Artificial Sequence
  Synthetic Polypeptide
MNTINIAKNDFSDIELAAIPFNTLADHYGERLAREQLALEHLSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 121 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHMSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 122 - protein, 884 aa, Artificial Sequence
  Synthetic Polypeptide
MNTINIAKNDFSDIELAAIPFNTLADHYGERLAREQLALEHMSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 123 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHKSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 124 - protein, 884 aa, Artificial Sequence
  Synthetic Polypeptide
MNTINIAKNDFSDIELAAIPFNTLADHYGERLAREQLALEHKSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 125 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHQSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 126 - protein, 884 aa, Artificial Sequence
  Synthetic Polypeptide
MNTINIAKNDFSDIELAAIPFNTLADHYGERLAREQLALEHQSYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 127 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHEIYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 128 - protein, 884 aa, Artificial Sequence
  Synthetic Polypeptide
MNTINIAKNDFSDIELAAIPFNTLADHYGERLAREQLALEHEIYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 129 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHELYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 130 - protein, 884 aa, Artificial Sequence
  Synthetic Polypeptide
MNTINIAKNDFSDIELAAIPFNTLADHYGERLAREQLALEHELYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 131 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHEMYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 132 - protein, 884 aa, Artificial Sequence
  Synthetic Polypeptide
MNTINIAKNDFSDIELAAIPFNTLADHYGERLAREQLALEHEMYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 133 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHEKYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 134 - protein, 884 aa, Artificial Sequence
  Synthetic Polypeptide
MNTINIAKNDFSDIELAAIPFNTLADHYGERLAREQLALEHEKYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 135 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHEQYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 136 - protein, 884 aa, Artificial Sequence
  Synthetic Polypeptide
MNTINIAKNDFSDIELAAIPFNTLADHYGERLAREQLALEHEQYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 137 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHEEYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 138 - protein, 884 aa, Artificial Sequence
  Synthetic Polypeptide
MNTINIAKNDFSDIELAAIPFNTLADHYGERLAREQLALEHEEYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 139 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESAEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 140 - protein, 884 aa, Artificial Sequence
  Synthetic Polypeptide
MNTINIAKNDFSDIELAAIPFNTLADHYGERLAREQLALEHESAEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 141 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESIEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 142 - protein, 884 aa, Artificial Sequence
  Synthetic Polypeptide
MNTINIAKNDFSDIELAAIPFNTLADHYGERLAREQLALEHESIEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 143 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESLEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 144 - protein, 884 aa, Artificial Sequence
  Synthetic Polypeptide
MNTINIAKNDFSDIELAAIPFNTLADHYGERLAREQLALEHESLEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 145 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESMEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 146 - protein, 884 aa, Artificial Sequence
  Synthetic Polypeptide
MNTINIAKNDFSDIELAAIPFNTLADHYGERLAREQLALEHESMEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 147 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESKEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 148 - protein, 884 aa, Artificial Sequence
  Synthetic Polypeptide
MNTINIAKNDFSDIELAAIPFNTLADHYGERLAREQLALEHESKEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 149 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESQEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 150 - protein, 884 aa, Artificial Sequence
  Synthetic Polypeptide
MNTINIAKNDFSDIELAAIPFNTLADHYGERLAREQLALEHESQEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 151 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESEEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 152 - protein, 884 aa, Artificial Sequence
  Synthetic Polypeptide
MNTINIAKNDFSDIELAAIPFNTLADHYGERLAREQLALEHESEEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 153 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYAMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 154 - protein, 884 aa, Artificial Sequence
  Synthetic Polypeptide
MNTINIAKNDFSDIELAAIPFNTLADHYGERLAREQLALEHESYAMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 155 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYIMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 156 - protein, 884 aa, Artificial Sequence
  Synthetic Polypeptide
MNTINIAKNDFSDIELAAIPFNTLADHYGERLAREQLALEHESYIMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 157 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYLMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 158 - protein, 884 aa, Artificial Sequence
  Synthetic Polypeptide
MNTINIAKNDFSDIELAAIPFNTLADHYGERLAREQLALEHESYLMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 159 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYMMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 160 - protein, 884 aa, Artificial Sequence
  Synthetic Polypeptide
MNTINIAKNDFSDIELAAIPFNTLADHYGERLAREQLALEHESYMMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 161 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYKMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 162 - protein, 884 aa, Artificial Sequence
  Synthetic Polypeptide
MNTINIAKNDFSDIELAAIPFNTLADHYGERLAREQLALEHESYKMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 163 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYQMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 164 - protein, 884 aa, Artificial Sequence
  Synthetic Polypeptide
MNTINIAKNDFSDIELAAIPFNTLADHYGERLAREQLALEHESYQMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 165 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEAGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 166 - protein, 884 aa, Artificial Sequence
  Synthetic Polypeptide
MNTINIAKNDFSDIELAAIPFNTLADHYGERLAREQLALEHESYEAGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 167 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEIGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 168 - protein, 884 aa, Artificial Sequence
  Synthetic Polypeptide
MNTINIAKNDFSDIELAAIPFNTLADHYGERLAREQLALEHESYEIGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 169 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYELGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 170 - protein, 884 aa, Artificial Sequence
  Synthetic Polypeptide
MNTINIAKNDFSDIELAAIPFNTLADHYGERLAREQLALEHESYELGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 171 - protein, 9 aa, Artificial Sequence
  Synthetic Polypeptide
  misc_feature (5)..(9): Xaa can be any naturally occurring amino acid
  MISC_FEATURE (6)..(9): may be absent
FAFAXXXXX

SEQ ID NO: 172 - protein, 4 aa, Artificial Sequence
  Synthetic Polypeptide
FAFA

SEQ ID NO: 173 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEKGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 174 - protein, 884 aa, Artificial Sequence
  Synthetic Polypeptide
MNTINIAKNDFSDIELAAIPFNTLADHYGERLAREQLALEHESYEKGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 175 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEQGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 176 - protein, 884 aa, Artificial Sequence
  Synthetic Polypeptide
MNTINIAKNDFSDIELAAIPFNTLADHYGERLAREQLALEHESYEQGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 177 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEEGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 178 - protein, 884 aa, Artificial Sequence
  Synthetic Polypeptide
MNTINIAKNDFSDIELAAIPFNTLADHYGERLAREQLALEHESYEEGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 179 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMIEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 180 - protein, 884 aa, Artificial Sequence
  Synthetic Polypeptide
MNTINIAKNDFSDIELAAIPFNTLADHYGERLAREQLALEHESYEMIEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 181 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMLEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 182 - protein, 884 aa, Artificial Sequence
  Synthetic Polypeptide
MNTINIAKNDFSDIELAAIPFNTLADHYGERLAREQLALEHESYEMLEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 183 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMMEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 184 - protein, 884 aa, Artificial Sequence
  Synthetic Polypeptide
MNTINIAKNDFSDIELAAIPFNTLADHYGERLAREQLALEHESYEMMEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 185 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMKEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 186 - protein, 884 aa, Artificial Sequence
  Synthetic Polypeptide
MNTINIAKNDFSDIELAAIPFNTLADHYGERLAREQLALEHESYEMKEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 187 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMQEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 188 - protein, 884 aa, Artificial Sequence
  Synthetic Polypeptide
MNTINIAKNDFSDIELAAIPFNTLADHYGERLAREQLALEHESYEMQEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 189 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMEEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 190 - protein, 884 aa, Artificial Sequence
  Synthetic Polypeptide
MNTINIAKNDFSDIELAAIPFNTLADHYGERLAREQLALEHESYEMEEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 191 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATIAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 192 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATIAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 193 - protein, 885 aa, Artificial Sequence
  Synthetic Polypeptide
  misc_feature (884)..(884): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATLAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXN

SEQ ID NO: 194 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATLAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 195 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATMAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 196 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATMAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 197 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATKAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 198 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATKAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 199 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATQAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 200 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATQAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 201 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATEAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 202 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATEAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 203 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRIGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 204 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRIGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 205 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRLGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 206 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRLGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 207 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRMGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 208 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRMGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 209 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRKGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 210 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRKGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 211 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRQGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 212 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRQGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 213 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATREGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 214 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATREGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 215 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAIALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 216 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAIALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 217 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRALALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 218 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRALALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 219 - protein, 885 aa, Artificial Sequence
  Synthetic Polypeptide
  misc_feature (884)..(884): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAMALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXN

SEQ ID NO: 220 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAMALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 221 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAKALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 222 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAKALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 223 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAQALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 224 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAQALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 225 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAEALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 226 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAEALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 227 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGILAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 228 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGILAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 229 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGLLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 230 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGLLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 231 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGMLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 232 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGMLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 233 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGKLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 234 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGKLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 235 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGQLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 236 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGQLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 237 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGELAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 238 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGELAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 239 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAAAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 240 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAIAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 241 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAIAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 242 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAMAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 243 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAMAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 244 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAKAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 245 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAKAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 246 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAQAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 247 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAQAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 248 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAEAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 249 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGAEAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 250 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALIGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 251 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALIGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 252 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALLGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 253 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALLGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 254 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALMGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 255 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALMGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 256 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALKGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 257 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALKGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 258 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALQGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 259 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALQGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 260 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALEGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 261 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALEGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 262 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHERYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 263 - protein, 884 aa, Artificial Sequence
  Synthetic Polypeptide
MNTINIAKNDFSDIELAAIPFNTLADHYGERLAREQLALEHERYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 264 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYRMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 265 - protein, 884 aa, Artificial Sequence
  Synthetic Polypeptide
MNTINIAKNDFSDIELAAIPFNTLADHYGERLAREQLALEHESYRMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 266 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMREARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 267 - protein, 884 aa, Artificial Sequence
  Synthetic Polypeptide
MNTINIAKNDFSDIELAAIPFNTLADHYGERLAREQLALEHESYEMREARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 268 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATWAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 269 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATWAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 270 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRARALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 271 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRARALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 272 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGRLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 273 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGRLAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 274 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKWVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 275 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKWVEEQLNKRVGHVYKKAFMQVVEADMLSKGLLGGEAWSSWHKEDSIHVGVRCIEMLIESTGMVSLHRQNAGVVGQDSETIELAPEYAEAIATRAALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 276 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVMEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 277 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVMEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 278 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVNEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 279 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVNEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 280 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEIQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 281 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEIQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 282 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVETQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 283 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVETQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 284 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEVQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 285 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEVQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 286 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKFFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 287 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKFFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 288 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKWFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 289 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKWFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 290 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMMVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 291 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMMVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 292 - protein, 888 aa, Artificial Sequence
  Synthetic Polypeptide
  misc_feature (884)..(888): Xaa can be any naturally occurring amino acid
  MISC_FEATURE (885)..(888): may be absent
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVFADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAXXXXX

SEQ ID NO: 293 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVFADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 294 - protein, 885 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAGG

SEQ ID NO: 295 - protein, 884 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAA

SEQ ID NO: 296 - protein, 885 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAAA

SEQ ID NO: 297 - protein, 885 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAGG

SEQ ID NO: 298 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAA

SEQ ID NO: 299 - protein, 885 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAAA

SEQ ID NO: 300 - protein, 883 aa, Artificial Sequence
  Synthetic Polypeptide
MNTINIAKNDFSDIELAAIPFNTLADHYGERLAREQLALEHEAYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 301 - protein, 884 aa, Artificial Sequence
  Synthetic Polypeptide
MNTINIAKNDFSDIELAAIPFNTLADHYGERLAREQLALEHEAYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 302 - protein, 9 aa, Artificial Sequence
  Synthetic Polypeptide
FAFAQQQQQ

SEQ ID NO: 303 - protein, 9 aa, Artificial Sequence
  Synthetic Polypeptide
FAFAHHHHH

SEQ ID NO: 304 - protein, 9 aa, Artificial Sequence
  Synthetic Polypeptide
FAFAIIIII

SEQ ID NO: 305 - protein, 9 aa, Artificial Sequence
  Synthetic Polypeptide
FAFALLLLL

SEQ ID NO: 306 - protein, 9 aa, Artificial Sequence
  Synthetic Polypeptide
FAFAKKKKK

SEQ ID NO: 307 - protein, 9 aa, Artificial Sequence
  Synthetic Polypeptide
FAFAMMMMM

SEQ ID NO: 308 - protein, 9 aa, Artificial Sequence
  Synthetic Polypeptide
FAFAFFFFF

SEQ ID NO: 309 - protein, 9 aa, Artificial Sequence
  Synthetic Polypeptide
FAFAPPPPP

SEQ ID NO: 310 - protein, 9 aa, Artificial Sequence
  Synthetic Polypeptide
FAFASSSSS

SEQ ID NO: 311 - protein, 9 aa, Artificial Sequence
  Synthetic Polypeptide
FAFATTTTT

SEQ ID NO: 312 - protein, 9 aa, Artificial Sequence
  Synthetic Polypeptide
FAFAWWWWW

SEQ ID NO: 313 - protein, 9 aa, Artificial Sequence
  Synthetic Polypeptide
FAFAYYYYY

SEQ ID NO: 314 - protein, 9 aa, Artificial Sequence
  Synthetic Polypeptide
FAFAVVVVV

SEQ ID NO: 315 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIITIAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 316 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIKTIAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 317 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIQTIAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 318 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIYTIAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 319 - protein, 7 aa, Artificial Sequence
  Synthetic Polypeptide
  misc_feature (5)..(7): Xaa can be any naturally occurring amino acid
FAFAXXX

SEQ ID NO: 320 - protein, 8 aa, Artificial Sequence
  Synthetic Polypeptide
  misc_feature (5)..(8): Xaa can be any naturally occurring amino acid
FAFAXXXX

SEQ ID NO: 321 - protein, 9 aa, Artificial Sequence
  Synthetic Polypeptide
  misc_feature (5)..(9): Xaa can be any naturally occurring amino acid
FAFAXXXXX

SEQ ID NO: 322 - protein, 6 aa, Artificial Sequence
  Synthetic Polypeptide
FAFAGG

SEQ ID NO: 323 - protein, 7 aa, Artificial Sequence
  Synthetic Polypeptide
FAFAGGG

SEQ ID NO: 324 - protein, 6 aa, Artificial Sequence
  Synthetic Polypeptide
FAFAGA

SEQ ID NO: 325 - protein, 6 aa, Artificial Sequence
  Synthetic Polypeptide
FAFAGC

SEQ ID NO: 326 - protein, 7 aa, Artificial Sequence
  Synthetic Polypeptide
FAFAGAA

SEQ ID NO: 327 - protein, 7 aa, Artificial Sequence
  Synthetic Polypeptide
FAFAGAG

SEQ ID NO: 328 - protein, 7 aa, Artificial Sequence
  Synthetic Polypeptide
FAFAGAC

SEQ ID NO: 329 - protein, 5 aa, Artificial Sequence
  Synthetic Polypeptide
FAFAG

SEQ ID NO: 330 - protein, 9 aa, Artificial Sequence
  Synthetic Polypeptide
  MISC_FEATURE (6)..(9): may be absent
FAFAGGGGG

SEQ ID NO: 331 - protein, 9 aa, Artificial Sequence
  Synthetic Polypeptide
  MISC_FEATURE (6)..(9): may be absent
FAFAAAAAA

SEQ ID NO: 332 - protein, 9 aa, Artificial Sequence
  Synthetic Polypeptide
  MISC_FEATURE (6)..(9): may be absent
FAFARRRRR

SEQ ID NO: 333 - protein, 9 aa, Artificial Sequence
  Synthetic Polypeptide
  MISC_FEATURE (6)..(9): may be absent
FAFANNNNN

SEQ ID NO: 334 - protein, 9 aa, Artificial Sequence
  Synthetic Polypeptide
  MISC_FEATURE (6)..(9): may be absent
FAFADDDDD

SEQ ID NO: 335 - protein, 9 aa, Artificial Sequence
  Synthetic Polypeptide
  MISC_FEATURE (6)..(9): may be absent
FAFACCCCC

SEQ ID NO: 336 - protein, 9 aa, Artificial Sequence
  Synthetic Polypeptide
  MISC_FEATURE (6)..(9): may be absent
FAFAEEEEE

What is claimed is:

1. A T7 ribonucleic acid (RNA) polymerase variant comprising an amino acid sequence having at least 90% identity to the amino acid sequence of SEQ ID NO: 1 modified to comprise an amino acid substitution at position G47, wherein the T7 RNA polymerase variant has RNA polymerase activity.

2. The T7 RNA polymerase variant of claim 1, wherein the amino acid substitution is selected from the group consisting of alanine, isoleucine, leucine, methionine, lysine, glutamine, and glutamate.

3. The T7 RNA polymerase variant of claim 2, wherein the amino acid substitution is alanine (G47A).

4. The T7 RNA polymerase variant of claim 1, wherein the T7 RNA polymerase variant comprises an amino acid sequence having at least 95% identity to SEQ ID NO:1.

5. The T7 RNA polymerase variant of claim 1 comprising an additional C-terminal amino acid.

6. The T7 RNA polymerase variant of claim 5, wherein the additional C-terminal amino acid comprises glycine (G).

7. The T7 RNA polymerase variant of claim 1, wherein the RNA polymerase variant comprises the amino acid sequence of SEQ ID NO:3.

8. The T7 RNA polymerase variant of claim 5 comprising two additional C-terminal amino acids.

9. The T7 RNA polymerase variant of claim 8, wherein the two additional C-terminal amino acids comprise the same type of amino acid or two different types of amino acids.

10. A T7 ribonucleic acid (RNA) polymerase variant comprising an amino acid sequence having at least 95% identity to the amino acid sequence of SEQ ID NO: 1 modified to comprise an alanine at position 47, wherein the T7 RNA polymerase variant has RNA polymerase activity.

11. The T7 RNA polymerase variant of claim 10 comprising the amino acid sequence of SEQ ID NO: 3.

12. The T7 RNA polymerase variant of claim 10 further comprising a C-terminal glycine.

13. The T7 RNA polymerase variant of claim 12 comprising the amino acid sequence of SEQ ID NO: 110.

14. A T7 RNA polymerase variant comprising the amino acid sequence of SEQ ID NO: 110.

* * * * *